(12) United States Patent
Alves-Junior et al.

(10) Patent No.: US 11,472,852 B2
(45) Date of Patent: Oct. 18, 2022

(54) COMPOSITIONS AND METHODS FOR IMPROVING CROP YIELDS THROUGH TRAIT STACKING

(71) Applicants: Monsanto Technology LLC, St. Louis, MO (US); BASF Plant Science LP, Research Triangle Park, NC (US); BASF Plant Science Company GmbH, Ludwigshafen am Rhein (DE)

(72) Inventors: Leonardo Alves-Junior, Limburgerhof (DE); Wesley B. Bruce, Raleigh, NC (US); Charles R. Dietrich, Chesterfield, MO (US); Natalia Ivleva, Webster Groves, MO (US); Kian Kiani, Cary, NC (US); Ryan Rapp, Hillsborough, NC (US); Thomas L. Slewinski, Chesterfield, MO (US)

(73) Assignees: Monsanto Technology LLC, St. Louis, MO (US); BASF Plant Science LP, Research Triangle Park, NC (US); BASF Plant Science Company GmbH, Ludwigshafen am Rhein (DE)

( * ) Notice: Subject to any disclaimer, the term of this patent is extended or adjusted under 35 U.S.C. 154(b) by 406 days.

(21) Appl. No.: 16/276,616

(22) Filed: Feb. 15, 2019

(65) Prior Publication Data
US 2019/0248843 A1    Aug. 15, 2019

Related U.S. Application Data

(60) Provisional application No. 62/631,344, filed on Feb. 15, 2018.

(51) Int. Cl.
| | | |
|---|---|---|
| *C12N 15/82* | (2006.01) | |
| *C07K 14/415* | (2006.01) | |
| *C12N 9/02* | (2006.01) | |
| *C12N 15/52* | (2006.01) | |

(52) U.S. Cl.
CPC .......... *C07K 14/415* (2013.01); *C12N 9/0004* (2013.01); *C12N 15/52* (2013.01); *C12N 15/8223* (2013.01); *C12N 15/8265* (2013.01)

(58) Field of Classification Search
None
See application file for complete search history.

(56) References Cited

U.S. PATENT DOCUMENTS

| | | |
|---|---|---|
| 5,159,135 A | 10/1992 | Umbeck |
| 5,188,958 A | 2/1993 | Moloney et al. |
| 5,322,938 A | 6/1994 | McPherson et al. |
| 5,352,605 A | 10/1994 | Fraley et al. |
| 5,463,174 A | 10/1995 | Moloney et al. |
| 5,510,474 A | 4/1996 | Quail et al. |
| 5,538,880 A | 7/1996 | Lundquist et al. |
| 5,550,318 A | 8/1996 | Lundquist et al. |
| 5,591,616 A | 1/1997 | Hiei et al. |
| 5,641,876 A | 6/1997 | McElroy et al. |
| 5,750,871 A | 5/1998 | Moloney et al. |
| 5,824,877 A | 10/1998 | Hinchee et al. |
| 6,153,812 A | 11/2000 | Fry et al. |
| 6,160,208 A | 12/2000 | Lundquist et al. |
| 6,194,636 B1 | 2/2001 | McElroy et al. |
| 6,232,526 B1 | 5/2001 | McElroy et al. |
| 6,372,211 B1 | 4/2002 | Isaac et al. |
| 6,384,301 B1 | 5/2002 | Martinell et al. |
| 6,399,861 B1 | 6/2002 | Anderson et al. |
| 6,420,547 B1 | 7/2002 | Maita et al. |
| 6,429,357 B1 | 8/2002 | McElroy et al. |
| 7,439,417 B2 | 10/2008 | da Costa e Silva et al. |
| 9,309,512 B2 | 4/2016 | Allen et al. |
| 2004/0111768 A1 | 6/2004 | e Silva et al. |
| 2004/0216189 A1 | 10/2004 | Houmard et al. |
| 2005/0160500 A1* | 7/2005 | Castigioni .......... C12N 15/8273 800/288 |
| 2005/0283856 A1* | 12/2005 | Conner .............. C12N 15/8225 800/300 |
| 2006/0200878 A1 | 9/2006 | Lutfiyya et al. |
| 2008/0052792 A1* | 2/2008 | da Costa e Silva ..... C12N 9/14 800/278 |
| 2009/0070898 A1 | 3/2009 | Allen et al. |
| 2011/0035839 A1 | 2/2011 | Lutfiyya et al. |

(Continued)

FOREIGN PATENT DOCUMENTS

| | | |
|---|---|---|
| CN | 103451200 A | 12/2013 |
| WO | 0009722 A2 | 2/2000 |
| WO | 2011140329 A1 | 11/2011 |

OTHER PUBLICATIONS

Doerks et al., (TIG, 14:248-250, 1998).*
Smith et al. (Nature Biotechnology, 15:1222-1223, 1997).*
Bork et al. (TIG, 12:425-427, 1996).*
Petti et al. (Plant Physiol., 169:705-716; Sep. 2015).*
Wenkel et al. (The Plant Cell, 18:2971-2984, 2006).*
Gutterson (HortScience 30:964-966,1995).*
Bruening (Proc. Natl. Acad. Sci., 95:13349-13351, 1998).*
Elomaa et al. (Molecular Breeding, 2:41-50, 1996).*
Colliver et al. (Plant molecular Biology, 35:509-522, 1997).*

(Continued)

*Primary Examiner* — Vinod Kumar
(74) *Attorney, Agent, or Firm* — Morrison & Foerster LLP

(57) ABSTRACT

The present disclosure provides modified, transgenic, or genome edited/mutated corn plants that are semi-dwarf and have one or more improved ear traits relative to a control plant, such as increase in ear area, increased single kernel weight, increased ear fresh weight, increased number of florets, and mitigated flowering delay. The modified, transgenic, or genome edited/mutated corn plants comprise a transgene encoding one or more CONSTANS (CO) or CONSTANS-like (COL) polypeptide and have a reduced expression of one or more GA20 or GA3 oxidase genes. Also provided are methods for producing the modified, transgenic, or genome edited/mutated corn plants.

34 Claims, 16 Drawing Sheets

Specification includes a Sequence Listing.

(56) References Cited

U.S. PATENT DOCUMENTS

| | | |
|---|---|---|
| 2011/0296555 A1 | 12/2011 | Ivashuta et al. |
| 2017/0114356 A1 | 4/2017 | Li et al. |
| 2018/0051295 A1* | 2/2018 | Allen .................. C12N 15/8218 |

OTHER PUBLICATIONS

Emery et al. (Current Biology 13:1768-1774, 2003).*
Nunes et al. (Planta 224:125-132; 2006).*
Arziman et al. (Nucleic Acids Research, 33:582-588, 2005).*
Bonawitz et al.,(Annu. Rev. Genet. 44: 337-363, 2010).*
Paul et al., (Plant Cell Reports; 35:1417-1427; 2016).*
Wells (Biochemistry 29:8509-8517, 1990).*
Guo et al. (PNAS, 101: 9205-9210, 2004 ).*
Ngo et al., (The Protein Folding Problem and Tertiary Structure Prediction, K. Merz., and S. Le Grand (eds.) pp. 492-495,1994).*
Thornton et al. (Nature structural Biology, structural genomics supplement, Nov. 2000).*
Keskin et al. (Protein Science, 13:1043-1055, 2004).*
Nishimura et al. (Plant Cell Physiol., 41 (5):583-590, 2000).*
Yang et al. (PNAS, 98:11438-11443, 2001).*
McConnell et al. (Nature, 411:709-713, 2001).*
Song et al. (Gene, 482:34-42, Published Aug. 2011; online version pp. 1-21 at the end of the article)).*
Qiao et al. (Plant Mol Biol Reporter, 29:952-960, 2011.*
Scofield et al. (Journal of Experimental Botany, 58:483-495, 2007).*
Allen et al., "Evolution of microRNA genes by inverted duplication of target gene sequences in *Arabidopsis thaliana,*" *Nat. Genet.,* 36:1282-1290 (2004).
Allen et al., "microRNA-Directed Phasing during Trans-Acting siRNA Biogenesis in Plants," *Cell,* 121:207-221 (2005).
Altschul et al., "Basic Local Alignment Search Tool," *J. Mol. Biol.* 215:403-410 (1990).
Altschul et al., "Gapped BLAST and PSI-BLAST: a new generation of protein database search programs," *Nucleic Acids Res.* 25:3389-3402 (1997).
Axtell et al., "A Two-Hit Trigger for siRNA Biogenesis in Plants," *Cell,* 127:565-577 (2006).
Beurdeley et al., "Compact designer TALENs for efficient genome engineering," *Nature Communications* 4:1762 (2013).
Cai, D et al., "Identification and characterization of CONSTANS-like (COL) gene family in upload cotton (*Gossynium hirsutum*)," PLoS One 12(6):1-13 (2017).
Fernandez-Suarez et al., "The 2013 *Nucleic Acids Research* Database Issue and the online Molecular Biology Database Collection," *Nucleic Acids Research* 41: D1-D7 (2013).
Cermak et al., "Efficient design and assembly of custom TALEN and other TAL effector-based constructs for DNA targeting," *Nucleic Acids Research* 39:e82 (2011).
Chenna R., et al., "Multiple sequence alignment with the Clustal series of programs," *Nucleic Acids Research* 31:3497-3500 (2003).
Colbert et al., "High-Throughput Screening for Induced Point Mutations," *Plant Physiol* 126:480-484 (2001).
Datta et al., "*Arabidopsis* CONSTANS-LIKE3 is a positive regulator of red light signaling and root growth," *Plant Cell* 18:70-84 (2006).
Doyle et al., "TAL Effector-Nucleotide targeter (TALE-NT) 2.0: tools for TAL effetor design and target prediction," *Nucleic Acids Research* 40:W117-W122 (2012).
Franco-Zorrilla et al., "Target mimicry provides a new mechanism for regulation of microRNA activity," *Nature Genetics,* 39:1033-1037 (2007).
Griffiths-Jones et al., Rfam: an RNA family database, *Nucleic Acids Res.,* 31:43 9-441 (2003).
Jones-Rhodes et al., "Computational Identification of Plant MicrRNAs and Their Targets, Including a Stress-Induced miRNA," *Molecular Cell* 14:787-799 (2004).
Katoh et al., "Specific residues at every third position of siRNA shape its efficient RNAi activity," *Nucleic Acids Res.* 10:1093 (2007).

Khanna et al., "The *Arabidopsis* B-Box Zinc Finger Family," *Plant Cell,* 21:3416-3420(2009).
Khvorova et al., "Functional siRNAs and miRNAs Exhibit Strand Bias," *Cell,* 115:209-216 (2003).
Kim et al., Nature Rev. Mol. Cell. Biol. 6:376-685 (2005).
Larkin MA et al., "Clustal W and Clustal X version 2.0," *Bioinformatics* 23:2947-2948 (2007).
Last et al., "pEmu: an improved promotor for gene expression in cereal cells," *Theor. Appl. Genet.* 81L581 (1991).
McCallum et al., Nat. Biotechnol 18:455-457 (2000).
McCormick et al., Leaf disc transformation of cultivated tomato (*L. esculentum*) using *Agrobacterium tumefaciens, Plant Cell Reports* 5:81-84 (1986).
Mcelroy et al., "Construction of expression vectors based on the rice actin 1 (Act1) 5' region for use in monocot transformation," *Mol. Gen. Genet.* 231:150 (1991).
Parizotto et al., "In vivo investigation of the transcription, processing, endonucleolytic activity, and functional relevance of the spatial distribution of a plant miRNA," *Genes Development.* 18:223 7-2242 (2004).
Putterill et al., "The CONSTANS gene of *Arabidopsis* Promotes Flowering and Encodes a Protein Showing Similarities to Zinc Finger Transcription Factors," *Cell,* 80:847-857 (1995).
Pater et al., "The promoter of the rice gene GOS2 is active in various different monocot tissues and binds rice nuclear factor ASF-1," *The Plant Journal* 2(6):837-44 (1992).
Rhoades et al., "Prediction of Plant MicroRNA Targets," *Cell* 110:513-520 (2002).
Robson et al., "Functional importance of conserved domains in the flowering-time gene CONSTANS demonstrated by analysis of mutant alleles and transgenic plants," *The Plant Journal* 28:619-631 (2001).
Reynolds et al., "Rational siRNA design for RNA interference," *Nature Biotechnol* 22:326-330 (2004).
Shimizu et al., "Photoperiod-regulated expression of the PpCOLI gene encoding a homolog of CO/COL protein in the moss *Physcomitrella patens,"* Biochem Biophys. Res. Commun., 324:1296-1301 (2004).
Suarez-Lopez et al., "CONSTANS mediates between the circadian clock and the control of flowering in *Arabidopsis,"* Nature, 410:1116-1120 (2001).
Sunkar et al., "Novel and Stress-Regulated microRNAs and Other Small RNAs from *Arabidopsis,"* Plant Cell 16:2001-2019 (2004).
Thompson J. D. et al., "Clustal W: improving the sensitivity of progressive multiple sequence alignment through sequence weighting, position-specific gap penalties and weight matrix choice," *Nucleic Acids Research* 22:4673-4680 (1994).
Vaucheret, "MicroRNA-Dependent Trans-Acting siRNA Production," *Science STKE,* (2005).
Yanik et al., PLoS One 9:e82539; 8(12) (2013).
Yoshikawa et al., "A pathway for the biogenesis of trans-acting siRNAs in *Arabidopsis,*" Genes Dev. 19:2164-2175 (2005).
Zeng et al., "Both Natural and Designed Micro RNAs Technique Can Inhibit the Expression of Cognate mRNAs When Expressed in Human Cells," *Molecular Cell* 9:1327-1333 (2002).
Anonymous. (Jan. 1, 1998). "Dwarf Com Earns Tall Praise," Retrieved from the Internet:URL:https ://www.farmprogress.com/dwarf-com-earns-tal1-prai se[retrieved on Sep. 21, 2021].
Coles, J. P. et al. (1999) "Modification of gibberellin production and plant development in *Arabidopsis* by sense and antisense expression of gibberellin 20-oxidase genes," The Plant Journal, 17(5): 547-556.
Hedden, P. et al. (2012). "Gibberellin biosynthesis and its regulation," Biochem. J. 444: 11-25.
International Search Report and Written Opinion, dated Jun. 24, 2019, for PCT Application No. PCT/US2010/018130, filed Feb. 15, 2019, 14 pages.
Qiao, F. et al. (Jun. 19, 2013) "Alteration of rice growth and development via antisense expression of OsGA20ox2 gene," African Journal of Biotechnology. 12(25): 3898-3904.

* cited by examiner

COMPOSITIONS AND METHODS FOR IMPROVING CROP YIELDS THROUGH TRAIT STACKING

CROSS-REFERENCE TO RELATED APPLICATION

This application claims benefit under 35 U.S.C. § 119(e) of U.S. Provisional Appln. No. 62/631,344, filed Feb. 15, 2018, herein incorporated by reference in its entirety.

INCORPORATION OF SEQUENCE LISTING

A sequence listing contained in the file named "Sequence_Listing_P34583US01.TXT" which is 1,220,465 bytes (measured in MS-Windows®) and was created on Feb. 5, 2019, is filed electronically herewith and incorporated by reference in its entirety.

FIELD

The present disclosure relates to transgenic and/or genome edited or mutated corn plants that are semi-dwarf and have one or more improved ear traits relative to a control plant, as well as methods for producing transgenic and/or genome edited or mutated corn plants through stacking.

BACKGROUND

Cereal crop yields have been steadily increasing over the past decades due to improved agronomic practices and traits. However, there continues to be a need in the art for improved corn yield through intrinsic yield gains and/or reduced yield losses from improved lodging resistance, stress tolerances and other traits.

SUMMARY

Figure 1:
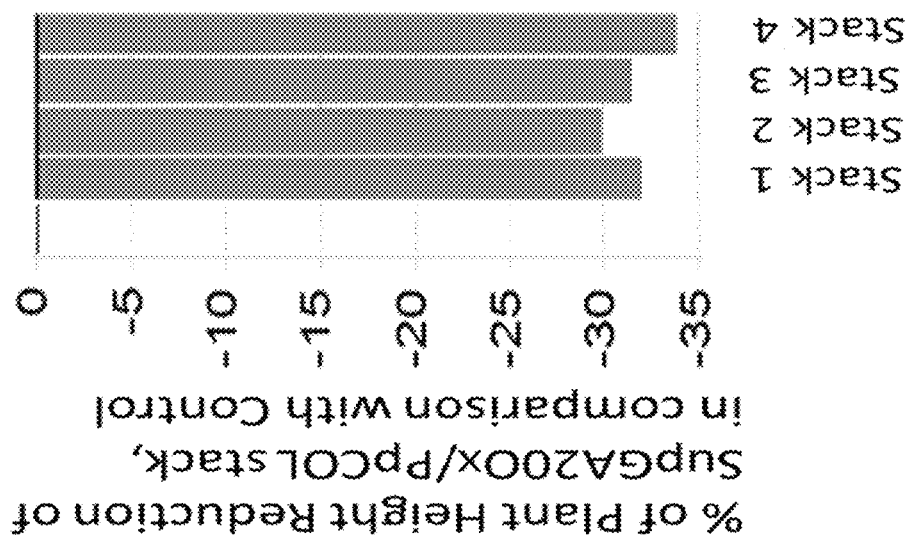
FIG. 1 shows plant heights of stacked transgenic corn plants ("GA20Ox_SUP/PpCOL stack") comprising a transgene encoding *Physcomitrella patens* CONSTANS-like 1 (PpCOL1) polypeptide and a DNA sequence encoding a miRNA for the suppression of GA20 oxidase (GA20Ox_SUP) across four transformation events, relative to control plants.

The present specification provides a modified corn plant or a plant part thereof comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, and 2) a second recombinant expression cassette comprising a DNA sequence encoding a CONSTANS (CO) or CONSTANS-like (COL) polypeptide.

The present specification also provides A plurality of modified corn plants in a field, each modified corn plant comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, and 2) a second recombinant expression cassette comprising a DNA sequence encoding a CO or COL polypeptide.

Also provided by the present specification is a method for producing a modified corn plant, the method comprising: a) introducing into a corn cell a first recombinant expression cassette comprising a DNA sequence encoding a CO or COL polypeptide, wherein the corn cell comprises a second recombinant expression cassette comprising a transcribable DNA sequence encoding a non-coding RNA for suppression of one or more GA3 oxidase genes and/or one or more GA20 oxidase genes; and b) regenerating or developing a modified corn plant from the corn cell, wherein the modified corn plant comprises the first and second recombinant expression cassettes.

Further provided by the present specification is a method for producing a modified corn plant, the method comprising: a) introducing into a corn cell a first recombinant expression cassette comprising a transcribable DNA sequence encoding a non-coding RNA for suppression of one or more GA3 oxidase genes and/or GA20 oxidase genes, wherein the corn cell comprises a second recombinant expression cassette comprising a DNA sequence encoding a CO and/or COL polypeptide; and b) regenerating or developing a modified corn plant from the corn cell, wherein the modified corn plant comprises the first and second recombinant expression cassettes.

In an aspect, the present specification provides a method for producing a modified corn plant, the method comprising a) introducing into a corn cell 1) a first recombinant expression cassette comprising a transcribable DNA sequence encoding a non-coding RNA for suppression of one or more GA3 oxidase genes and/or GA20 oxidase genes and 2) a second recombinant expression cassette comprising a DNA sequence encoding a CO or COL polypeptide; and b) regenerating or developing a modified corn plant from the corn cell, wherein the modified corn plant comprises the first and second recombinant expression cassettes.

In another aspect, the present specification provides a method for producing a modified corn plant, the method comprising a) introducing into a corn cell a first recombinant expression cassette comprising a transcribable DNA sequence encoding a non-coding RNA for suppression of one or more GA3 oxidase genes and/or GA20 oxidase genes; b) introducing into the corn cell of step (a) a second recombinant expression cassette comprising a DNA sequence encoding a CO or COL polypeptide to create a modified corn cell; and c) regenerating or developing a modified corn plant from the modified corn cell of step (b), wherein the modified corn plant comprises the first and second recombinant expression cassettes.

In an still another aspect, the present specification provides a method for producing a modified corn plant, the method comprising a) introducing into a corn cell a first recombinant expression cassette comprising a DNA sequence encoding a CO or COL polypeptide; b) introducing into the corn cell of step (a) a second recombinant expression cassette comprising a transcribable DNA sequence encoding a non-coding RNA for suppression of one or more GA3 oxidase genes and/or GA20 oxidase genes to create a modified corn cell; and c) regenerating or developing a modified corn plant from the modified corn cell of step (b), wherein the modified corn plant comprises the first and second recombinant expression cassettes.

The present specification provides a method for producing a modified corn plant, the method comprising: a) crossing a first modified corn plant with a second modified corn plant, wherein the expression or activity of one or more endogenous GA3 oxidase genes and/or GA20 oxidase genes is reduced in the first modified corn plant relative to a wildtype control, and wherein the second modified corn plant comprises a recombinant expression cassette comprising a DNA sequence encoding a CO or COL polypeptide; and b) producing a progeny corn plant comprising the recombinant expression cassette and has the reduced expression of the one or more endogenous GA3 oxidase genes and/or GA20 oxidase genes.

The present specification also provides A method for producing a modified corn plant, the method comprising: a) introducing into a corn cell a recombinant expression cassette comprising a DNA sequence encoding a CO or COL polypeptide, wherein the DNA sequence is operably linked to a plant-expressible promoter, and wherein the corn cell comprises one or more mutations and/or edits in one or more endogenous GA3 oxidase and/or GA20 oxidase genes; and b) regenerating or developing a modified corn plant from the corn cell, wherein the modified corn plant comprises the recombinant expression cassette and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

Also provided by the present specification is A method for producing a modified corn plant, the method comprising: a) mutating or editing one or more endogenous GA3 oxidase genes and/or one or more GA20 oxidase genes in a corn cell, wherein the corn cell comprises a recombinant expression cassette encoding a CO or COL polypeptide, wherein the DNA sequence is operably linked to a plant-expressible promoter; and b) regenerating or developing a modified corn plant from the corn cell, wherein the modified corn plant comprises the recombinant expression cassette and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

Further provided by the present specification is a modified corn plant comprising 1) one or more mutations or edits at or near one or more endogenous GA20 oxidase and/or GA3 oxidase genes, wherein the expression or activity of the one or more endogenous GA20 oxidase and/or GA3 oxidase genes is reduced relative to a wildtype control plant, and 2) a recombinant expression cassette comprising a DNA sequence encoding a CO or COL polypeptide, wherein the DNA sequence is operably linked to a plant-expressible promoter.

In an aspect, the present specification provides a plurality of modified corn plants in a field, each modified corn plant comprising 1) one or more mutations or edits at or near one or more endogenous GA20 oxidase and/or GA3 oxidase genes, wherein the expression of the one or more endogenous GA20 oxidase and/or GA3 oxidase genes are reduced relative to a wildtype control plant, and 2) a recombinant expression cassette comprising a DNA sequence encoding a CO or COL polypeptide, wherein the DNA sequence is operably linked to a plant-expressible promoter.

In another aspect, the present specification provides a recombinant DNA construct comprising 1) a first expression cassette comprising a transcribable DNA sequence encoding a non-coding RNA for suppression of one or more GA20 oxidase or one or more GA3 oxidase genes, and 2) a second expression cassette comprising a DNA sequence encoding a CO or COL polypeptide, wherein the DNA sequence is operably linked to a plant-expressible promoter.

In still another aspect, the present specification provides A recombinant DNA donor template molecule for site directed integration of an insertion sequence into the genome of a corn plant comprising an insertion sequence and at least one homology sequence, wherein the homology sequence is at least 70%, at least 75%, at least 80%, at least 85%, at least 90%, at least 95%, at least 96%, at least 97%, at least 99% or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a target DNA sequence in the genome of a corn plant cell, and wherein the insertion sequence comprises an expression cassette comprising a DNA sequence encoding a CO or COL polypeptide, wherein the DNA sequence is operably linked to a plant-expressible promoter.

DESCRIPTION

Definitions

Unless defined otherwise herein, terms are to be understood according to conventional usage by those of ordinary skill in the relevant art. Examples of resources describing many of the terms related to molecular biology used herein can be found in Alberts et al., Molecular Biology of The Cell, 5th Edition, Garland Science Publishing, Inc.: New York, 2007; Rieger et al., Glossary of Genetics: Classical and Molecular, 5th edition, Springer-Verlag: New York, 1991; King et al, A Dictionary of Genetics, 6th ed., Oxford University Press: New York, 2002; and Lewin, Genes IX, Oxford University Press: New York, 2007.

Any references cited herein, including, e.g., all patents, published patent applications, and non-patent publications, are incorporated by reference in their entirety. To facilitate understanding of the disclosure, several terms and abbreviations as used herein are defined below as follows:

The term "and/or" when used in a list of two or more items, means that any one of the listed items can be employed by itself or in combination with any one or more of the listed items. For example, the expression "A and/or B" is intended to mean either or both of A and B—i.e., A alone, B alone, or A and B in combination. The expression "A, B and/or C" is intended to mean A alone, B alone, C alone, A and B in combination, A and C in combination, B and C in combination, or A, B, and C in combination.

The term "about" as used herein, is intended to qualify the numerical values that it modifies, denoting such a value as variable within a margin of error. When no particular margin of error, such as a standard deviation to a mean value, is recited, the term "about" should be understood to mean that range which would encompass the recited value and the range which would be included by rounding up or down to that figure, taking into account significant figures.

As used herein, a "plant" includes an explant, plant part, seedling, plantlet or whole plant at any stage of regeneration or development. The term "cereal plant" as used herein refers to a monocotyledonous (monocot) crop plant that is in the Poaceae or Gramineae family of grasses and is typically harvested for its seed, including, for example, wheat, corn, rice, millet, barley, sorghum, oat and rye. As commonly understood, a "corn plant" or "maize plant" refers to any plant of species *Zea mays* and includes all plant varieties that can be bred with corn, including wild maize species.

As used herein, a "plant part" can refer to any organ or intact tissue of a plant, such as a meristem, shoot organ/structure (e.g., leaf, stem or node), root, flower or floral organ/structure (e.g., bract, sepal, petal, stamen, carpel, anther and ovule), seed (e.g., embryo, endosperm, and seed coat), fruit (e.g., the mature ovary), propagule, or other plant tissues (e.g., vascular tissue, dermal tissue, ground tissue, and the like), or any portion thereof. Plant parts of the present disclosure can be viable, nonviable, regenerable, and/or non-regenerable. A "propagule" can include any plant part that can grow into an entire plant.

As used herein, a "transgenic plant" refers to a plant whose genome has been altered by the integration or insertion of a recombinant DNA molecule, construct, cassette or sequence for expression of a non-coding RNA molecule, mRNA and/or protein in the plant. A transgenic plant includes an $R_0$ plant developed or regenerated from an originally transformed plant cell(s) as well as progeny transgenic plants in later generations or crosses from the $R_0$ transgenic plant that comprise the recombinant DNA molecule, construct, cassette or sequence. A plant having an integrated or inserted recombinant DNA molecule, construct, cassette or sequence is considered a transgenic plant even if the plant also has other mutation(s) or edit(s) that would not themselves be considered transgenic.

A plant cell is a biological cell of a plant, taken from a plant or derived through culture from a cell taken from a plant. As used herein, a "transgenic plant cell" refers to any plant cell that is transformed with a stably-integrated recombinant DNA molecule, construct, cassette, or sequence. A transgenic plant cell can include an originally-transformed plant cell, a transgenic plant cell of a regenerated or developed $R_0$ plant, a transgenic plant cell cultured from another transgenic plant cell, or a transgenic plant cell from any progeny plant or offspring of the transformed $R_0$ plant, including cell(s) of a plant seed or embryo, or a cultured plant cell, callus cell, etc.

As used herein, the term "transcribable DNA sequence" refers to a DNA sequence that can be transcribed into an RNA molecule. The RNA molecule can be coding or non-coding and may or may not be operably linked to a promoter and/or other regulatory sequences.

For purposes of the present disclosure, a "non-coding RNA molecule" is a RNA molecule that does not encode a protein. Non-limiting examples of a non-coding RNA molecule include a microRNA (miRNA), a miRNA precursor, a small interfering RNA (siRNA), a siRNA precursor, a small RNA (18-26 nt in length) and precursors encoding the same, a heterochromatic siRNA (hc-siRNA), a Piwi-interacting RNA (piRNA), a hairpin double strand RNA (hairpin dsRNA), a trans-acting siRNA (ta-siRNA), a naturally occurring antisense siRNA (nat-siRNA), a CRISPR RNA (crRNA), a tracer RNA (tracrRNA), a guide RNA (gRNA), and a single-guide RNA (sgRNA).

The terms "suppressing"/"suppression" or "reduced"/"reduction" when used in reference to a gene(s), refers to a lowering, reduction, or elimination of the expression level of a mRNA and/or protein encoded by the gene(s), and/or a lowering, reduction, or elimination of the activity of a protein encoded by the gene(s) in a plant, plant cell or plant tissue, at one or more stage(s) of plant development, as compared to the expression level of such target mRNA and/or protein, and/or the activity of such encoded protein in a wild-type or control plant, cell or tissue at the same stage(s) of plant development.

As used herein, the term "consecutive" in reference to a polynucleotide or protein sequence means without deletions or gaps in the sequence.

As commonly understood in the art, a "mutation" refers to any alteration of the nucleotide sequence of the genome, extrachromosomal DNA, or other genetic element of an organism (e.g., a gene or regulatory element operably linked to a gene in a plant), such as a nucleotide insertion, deletion, inversion, substitution, duplication, etc.

The terms "percent identity" or "percent identical" as used herein in reference to two or more nucleotide or protein sequences is calculated by (i) comparing two optimally aligned sequences (nucleotide or protein) over a window of comparison, (ii) determining the number of positions at which the identical nucleic acid base (for nucleotide sequences) or amino acid residue (for proteins) occurs in both sequences to yield the number of matched positions, (iii) dividing the number of matched positions by the total number of positions in the window of comparison, and then (iv) multiplying this quotient by 100% to yield the percent identity. For purposes of calculating "percent identity" between DNA and RNA sequences, a uracil (U) of a RNA sequence is considered identical to a thymine (T) of a DNA sequence. If the window of comparison is defined as a region of alignment between two or more sequences (i.e., excluding nucleotides at the 5' and 3' ends of aligned polynucleotide sequences, or amino acids at the N-terminus and C-terminus of aligned protein sequences, that are not identical between the compared sequences), then the "percent identity" can also be referred to as a "percent alignment identity". If the "percent identity" is being calculated in relation to a reference sequence without a particular comparison window being specified, then the percent identity is determined by dividing the number of matched positions over the region of alignment by the total length of the reference sequence. Accordingly, for purposes of the present disclosure, when two sequences (query and subject) are optimally aligned (with allowance for gaps in their alignment), the "percent identity" for the query sequence is equal to the number of identical positions between the two sequences divided by the total number of positions in the query sequence over its length (or a comparison window), which is then multiplied by 100%.

It is recognized that residue positions of proteins that are not identical often differ by conservative amino acid substitutions, where amino acid residues are substituted for other amino acid residues with similar size and chemical properties (e.g., charge, hydrophobicity, polarity, etc.), and therefore may not change the functional properties of the molecule. When sequences differ in conservative substitutions, the percent sequence similarity can be adjusted upwards to correct for the conservative nature of the non-identical substitution(s). Sequences that differ by such conservative substitutions are said to have "sequence similarity" or "similarity." Thus, "percent similarity" or "percent similar" as used herein in reference to two or more protein sequences is calculated by (i) comparing two optimally aligned protein sequences over a window of comparison, (ii) determining the number of positions at which the same or similar amino acid residue occurs in both sequences to yield the number of matched positions, (iii) dividing the number of matched positions by the total number of positions in the window of comparison (or the total length of the reference or query protein if a window of comparison is not specified), and then (iv) multiplying this quotient by 100% to yield the percent similarity. Conservative amino acid substitutions for proteins are known in the art.

For optimal alignment of sequences to calculate their percent identity or similarity, various pair-wise or multiple sequence alignment algorithms and programs are known in the art, such as ClustalW, or Basic Local Alignment Search Tool® (BLAST®), etc., that can be used to compare the sequence identity or similarity between two or more nucleotide or protein sequences. Although other alignment and comparison methods are known in the art, the alignment between two sequences (including the percent identity ranges described above) can be as determined by the ClustalW or BLAST® algorithm, see, e.g., Chenna R. et al., "Multiple sequence alignment with the Clustal series of programs," *Nucleic Acids Research* 31: 3497-3500 (2003); Thompson J D et al., "Clustal W: Improving the sensitivity of progressive multiple sequence alignment through sequence weighting, position-specific gap penalties and weight matrix choice," *Nucleic Acids Research* 22: 4673-4680 (1994); and Larkin M A et al., "Clustal W and Clustal X version 2.0," *Bioinformatics* 23: 2947-48 (2007); and Altschul, S. F., Gish, W., Miller, W., Myers, E. W. & Lipman, D. J. (1990) "Basic local alignment search tool." *J. Mol. Biol.* 215:403-410 (1990), the entire contents and disclosures of which are incorporated herein by reference.

The terms "percent complementarity" or "percent complementary", as used herein in reference to two nucleotide sequences, is similar to the concept of percent identity but refers to the percentage of nucleotides of a query sequence that optimally base-pair or hybridize to nucleotides of a subject sequence when the query and subject sequences are linearly arranged and optimally base paired without secondary folding structures, such as loops, stems or hairpins. Such a percent complementarity can be between two DNA strands, two RNA strands, or a DNA strand and a RNA strand. The "percent complementarity" is calculated by (i) optimally base-pairing or hybridizing the two nucleotide sequences in a linear and fully extended arrangement (i.e., without folding or secondary structures) over a window of comparison, (ii) determining the number of positions that base-pair between the two sequences over the window of comparison to yield the number of complementary positions, (iii) dividing the number of complementary positions by the total number of positions in the window of comparison, and (iv) multiplying this quotient by 100% to yield the percent complementarity of the two sequences. Optimal base pairing of two sequences can be determined based on the known pairings of nucleotide bases, such as G-C, A-T, and A-U, through hydrogen bonding. If the "percent complementarity" is being calculated in relation to a reference sequence without specifying a particular comparison window, then the percent identity is determined by dividing the number of complementary positions between the two linear sequences by the total length of the reference sequence. Thus, for purposes of the present disclosure, when two sequences (query and subject) are optimally base-paired (with allowance for mismatches or non-base-paired nucleotides but without folding or secondary structures), the "percent complementarity" for the query sequence is equal to the number of base-paired positions between the two sequences divided by the total number of positions in the query sequence over its length (or by the number of positions in the query sequence over a comparison window), which is then multiplied by 100%.

The term "operably linked" refers to a functional linkage between a promoter or other regulatory element and an associated transcribable DNA sequence or coding sequence of a gene (or transgene), such that the promoter, etc., operates or functions to initiate, assist, affect, cause, and/or promote the transcription and expression of the associated transcribable DNA sequence or coding sequence, at least in certain cell(s), tissue(s), developmental stage(s), and/or condition(s).

As commonly understood in the art, the term "promoter" can generally refer to a DNA sequence that contains an RNA polymerase binding site, transcription start site, and/or TATA box and assists or promotes the transcription and expression of an associated transcribable polynucleotide sequence and/or gene (or transgene). A promoter can be synthetically produced, varied or derived from a known or naturally occurring promoter sequence or other promoter sequence. A promoter can also include a chimeric promoter comprising a combination of two or more heterologous sequences. A promoter of the present disclosure can thus include variants of promoter sequences that are similar in composition, but not identical to, other promoter sequence(s) known or provided herein. A promoter can be classified according to a variety of criteria relating to the pattern of expression of an associated coding or transcribable sequence or gene (including a transgene) operably linked to the promoter, such as constitutive, developmental, tissue-specific, inducible, etc. Promoters that drive expression in all or most tissues of the plant are referred to as "constitutive" promoters. Promoters that drive expression during certain periods or stages of development are referred to as "developmental" promoters. Promoters that drive enhanced expression in certain tissues of the plant relative to other plant tissues are referred to as "tissue-enhanced" or "tissue-preferred" promoters. Thus, a "tissue-preferred" promoter causes relatively higher or preferential expression in a specific tissue(s) of the plant, but with lower levels of expression in other tissue(s) of the plant. Promoters that express within a specific tissue(s) of the plant, with little or no expression in other plant tissues, are referred to as "tissue-specific" promoters. An "inducible" promoter is a promoter that initiates transcription in response to an environmental stimulus such as cold, drought or light, or other stimuli, such as wounding or chemical application. A promoter can also be classified in terms of its origin, such as being heterologous, homologous, chimeric, synthetic, etc.

As used herein, a "plant-expressible promoter" refers to a promoter that can initiate, assist, affect, cause, and/or promote the transcription and expression of its associated transcribable DNA sequence, coding sequence or gene in a corn plant cell or tissue.

As used herein, a "heterologous plant-expressible promoter" refers to a plant-expressible promoter which does not naturally occur adjacent to or associated with the referenced gene or nucleic acid sequence in its natural environment, but which is positioned by laboratory manipulation.

As used herein, a "vascular promoter" refers to a plant-expressible promoter that drives, causes or initiates expression of a transcribable DNA sequence or transgene operably linked to such promoter in one or more vascular tissue(s) of the plant, even if the promoter is also expressed in other non-vascular plant cell(s) or tissue(s). Such vascular tissue(s) can comprise one or more of the phloem, vascular parenchymal, and/or bundle sheath cell(s) or tissue(s) of the plant. A "vascular promoter" is distinguished from a constitutive promoter in that it has a regulated and relatively more limited pattern of expression that includes one or more vascular tissue(s) of the plant. A vascular promoter includes both vascular-specific promoters and vascular-preferred promoters.

As used herein, a "leaf promoter" refers to a plant-expressible promoter that drives, causes or initiates expression of a transcribable DNA sequence or transgene operably linked to such promoter in one or more leaf tissue(s) of the plant, even if the promoter is also expressed in other non-leaf plant cell(s) or tissue(s). A leaf promoter includes both leaf-specific promoters and leaf-preferred promoters. A "leaf promoter" is distinguished from a vascular promoter in that it is expressed more predominantly or exclusively in leaf tissue(s) of the plant relative to other plant tissues, whereas a vascular promoter is expressed in vascular tissue(s) more generally including vascular tissue(s) outside of the leaf, such as the vascular tissue(s) of the stem, or stem and leaves, of the plant.

The term "heterologous" in reference to a promoter or other regulatory sequence in relation to an associated polynucleotide sequence (e.g., a transcribable DNA sequence or coding sequence or gene) is a promoter or regulatory sequence that is not operably linked to such associated polynucleotide sequence in nature—e.g., the promoter or regulatory sequence has a different origin relative to the associated polynucleotide sequence and/or the promoter or regulatory sequence is not naturally occurring in a plant species to be transformed with the promoter or regulatory sequence.

The term "recombinant" in reference to a polynucleotide (DNA or RNA) molecule, protein, construct, vector, etc., refers to a polynucleotide or protein molecule or sequence that is man-made and not normally found in nature, and/or is present in a context in which it is not normally found in nature, including a polynucleotide (DNA or RNA) molecule, protein, construct, etc., comprising a combination of two or more polynucleotide or protein sequences that would not naturally occur together in the same manner without human intervention, such as a polynucleotide molecule, protein, construct, etc., comprising at least two polynucleotide or protein sequences that are operably linked but heterologous with respect to each other. For example, the term "recombinant" can refer to any combination of two or more DNA or protein sequences in the same molecule (e.g., a plasmid, construct, vector, chromosome, protein, etc.) where such a combination is man-made and not normally found in nature. As used in this definition, the phrase "not normally found in nature" means not found in nature without human introduction. A recombinant polynucleotide or protein molecule, construct, etc., can comprise polynucleotide or protein sequence(s) that is/are (i) separated from other polynucleotide or protein sequence(s) that exist in proximity to each other in nature, and/or (ii) adjacent to (or contiguous with) other polynucleotide or protein sequence(s) that are not naturally in proximity with each other. Such a recombinant polynucleotide molecule, protein, construct, etc., can also refer to a polynucleotide or protein molecule or sequence that has been genetically engineered and/or constructed outside of a cell. For example, a recombinant DNA molecule can comprise any engineered or man-made plasmid, vector, etc., and can include a linear or circular DNA molecule. Such plasmids, vectors, etc., can contain various maintenance elements including a prokaryotic origin of replication and selectable marker, as well as one or more transgenes or expression cassettes perhaps in addition to a plant selectable marker gene, etc.

As used herein, the term "isolated" refers to at least partially separating a molecule from other molecules typically associated with it in its natural state. In an aspect, the term "isolated" refers to a DNA molecule that is separated from the nucleic acids that normally flank the DNA molecule in its natural state. For example, a DNA molecule encoding a protein that is naturally present in a bacterium would be an isolated DNA molecule if it was not within the DNA of the bacterium from which the DNA molecule encoding the protein is naturally found. Thus, a DNA molecule fused to or operably linked to one or more other DNA molecule(s) with which it would not be associated in nature, for example as the result of recombinant DNA or plant transformation techniques, is considered isolated herein. Such molecules are considered isolated even when integrated into the chromosome of a host cell or present in a nucleic acid solution with other DNA molecules.

As used herein, an "encoding region" or "coding region" refers to a portion of a polynucleotide that encodes a functional unit or molecule (e.g., without being limiting, a mRNA, protein, or non-coding RNA sequence or molecule).

As used herein, "modified" in the context of a plant, plant seed, plant part, plant cell, and/or plant genome, refers to a plant, plant seed, plant part, plant cell, and/or plant genome comprising an engineered change in the expression level and/or coding sequence of one or more gene(s) relative to a wild-type or control plant, plant seed, plant part, plant cell, and/or plant genome, such as via a transgenic event or a genome editing event or mutation affecting the expression level or activity of one or more genes. Modified plants, plant parts, seeds, etc., can be subjected to or created by mutagenesis, genome editing or site-directed integration (e.g., without being limiting, via methods using site-specific nucleases), genetic transformation (e.g., without being limiting, via methods of Agrobacterium transformation or microprojectile bombardment), or a combination thereof. Such "modified" plants, plant seeds, plant parts, and plant cells include plants, plant seeds, plant parts, and plant cells that are offspring or derived from "modified" plants, plant seeds, plant parts, and plant cells that retain the molecular change (e.g., change in expression level and/or activity) to the one or more genes. A modified seed provided herein can give rise to a modified plant provided herein. A modified plant, plant seed, plant part, plant cell, or plant genome provided herein can comprise a recombinant DNA construct or vector or genome edit as provided herein. A "modified plant product" can be any product made from a modified plant, plant part, plant cell, or plant chromosome provided herein, or any portion or component thereof.

As used herein, the term "control plant" (or likewise a "control" plant seed, plant part, plant cell and/or plant genome) refers to a plant (or plant seed, plant part, plant cell and/or plant genome) that is used for comparison to a modified plant (or modified plant seed, plant part, plant cell and/or plant genome) and has the same or similar genetic background (e.g., same parental lines, hybrid cross, inbred line, testers, etc.) as the modified plant (or plant seed, plant part, plant cell and/or plant genome), except for a transgene, expression cassette, mutation, and/or genome edit affecting one or more genes. For purposes of comparison to a modified plant, plant seed, plant part, plant cell and/or plant genome, a "wild-type plant" (or likewise a "wild-type" plant seed, plant part, plant cell and/or plant genome) refers to a non-transgenic, non-mutated, and non-genome edited control plant, plant seed, plant part, plant cell and/or plant genome. Alternatively as can be specified herein, such a "control plant" (or likewise a "control" plant seed, plant part, plant cell and/or plant genome) can refer to a plant (or plant seed, plant part, plant cell and/or plant genome) that (i) is used for comparison to a modified plant (or modified plant seed, plant part, plant cell and/or plant genome) having a stack of two or more transgene(s), expression cassette(s), mutation(s) and/or genome edit(s), (ii) has the same or similar genetic background (e.g., same parental lines, hybrid cross, inbred line, testers, etc.) as the modified plant (or plant seed, plant part, plant cell and/or plant genome), but (iii) lacks at least one of the two or more transgene(s), expression cassette(s), mutation(s) and/or genome edit(s) of the modified plant (e.g., a stack in comparison to a single of one of the members of the stack). As used herein, such a "control" plant, plant seed, plant part, plant cell and/or plant genome can also be a plant, plant seed, plant part, plant cell and/or plant genome having a similar (but not the same or identical) genetic background to a modified plant, plant seed, plant part, plant cell and/or plant genome, if deemed sufficiently similar for comparison of the characteristics or traits to be analyzed.

As used herein, "crossed" or "cross" means to produce progeny via fertilization (e.g., cells, seeds or plants) and includes crosses between plants (sexual) and self-fertilization (selfing).

As used herein, "ear trait" of a corn plant refers to a characteristic of an ear of a corn plant. In an aspect, an ear trait can include, but is not limited to, ear area, single kernel weight, ear fresh weight, and/or number of florets. In another aspect, an ear trait can include, but is not limited to, ear diameter, ear length, ear tip void, ear void, ear volume, kernel number, kernel number per row, kernel number per ear, kernels per field area, kernel rank, kernel row number, kernel weight, single kernel weight, yield, and/or grain yield estimate. In yet another aspect, an ear trait can include, but is not limited to, ear attitude, ear cob color, ear cob diameter, ear cob strength, ear dry husk color, ear fresh husk color, ear husk bract, ear husk cover, ear husk opening, ear number per stalk, ear shank length, ear shelling percent, ear silk color, ear taper, ear weight, ear rot rating, kernel aleurone color, kernel cap color, kernel endosperm color, kernel endosperm type, kernel grade, kernel length, kernel pericarp color, kernel row direction, kernel side color, kernel thickness, kernel type, kernel width, cob weight, and/or prolificacy. A modified or genome edited/mutated corn plant of the present disclosure exhibits one or more improved ear trait compared to a control corn plant. In an aspect, a modified or genome edited/mutated corn plant exhibits an increased ear area relative to a control corn plant. In an aspect, a modified or genome edited/mutated corn plant exhibits increased kernel weight relative to a control corn plant. In an aspect, a modified or genome edited/mutated corn plant exhibits an increased ear fresh weight relative to a control corn plant.

As used herein, "yield" refers to the total amount of an agricultural product (e.g., seeds, fruit, etc.) produced or harvested from a plurality of crop plants per unit area of land cultivation (e.g., a field of crop plants) as understood in the art. Yield can be measured or estimated in a greenhouse, in a field, or under specific environment, treatment and/or stress conditions. For example, as known and understood in the art, yield can be measured in units of kilograms per hectare, bushels per acre, or the like. Indeed, yield can be measured in terms of "broad acreage yield" or "BAY" as known and understood in the art.

As used herein, "comparable conditions" for plants refers to the same or similar environmental conditions and agronomic practices for growing and making meaningful comparisons between two or more plant genotypes so that neither environmental conditions nor agronomic practices would significantly contribute to, or explain, any differences observed between the two or more plant genotypes. Environmental conditions include, for example, light, temperature, water, humidity, soil, and nutrition (e.g., nitrogen and phosphorus).

As used herein, a "targeted genome editing technique" refers to any method, protocol, or technique that allows the precise and/or targeted editing of a specific location in a genome of a plant (i.e., the editing is largely or completely non-random) using a site-specific nuclease, such as a meganuclease, a zinc-finger nuclease (ZFN), an RNA-guided endonuclease (e.g., the CRISPR/Cas9 system), a TALE-endonuclease (TALEN), a recombinase, or a transposase.

As used herein, "editing" or "genome editing" refers to generating a targeted mutation, deletion, inversion or substitution of at least 1, at least 2, at least 3, at least 4, at least 5, at least 6, at least 7, at least 8, at least 9, at least 10, at least 15, at least 20, at least 25, at least 30, at least 35, at least 40, at least 45, at least 50, at least 75, at least 100, at least 250, at least 500, at least 1000, at least 2500, at least 5000, at least 10,000, or at least 25,000 nucleotides of an endogenous plant genome nucleic acid sequence using a targeted genome editing technique. As used herein, "editing" or "genome editing" also encompasses the targeted insertion or site-directed integration of at least 1, at least 2, at least 3, at least 4, at least 5, at least 6, at least 7, at least 8, at least 9, at least 10, at least 15, at least 20, at least 25, at least 30, at least 35, at least 40, at least 45, at least 50, at least 75, at least 100, at least 250, at least 500, at least 750, at least 1000, at least 1500, at least 2000, at least 2500, at least 3000, at least 4000, at least 5000, at least 10,000, or at least 25,000 nucleotides into the endogenous genome of a plant using a targeted genome editing technique.

As used herein, a "target site" for genome editing refers to the location of a polynucleotide sequence within a plant genome that is targeted and cleaved by a site-specific nuclease introducing a double stranded break (or single-stranded nick) into the nucleic acid backbone of the polynucleotide sequence and/or its complementary DNA strand. A site-specific nuclease can bind to a target site, such as via a non-coding guide RNA (e.g., without being limiting, a CRISPR RNA (crRNA) or a single-guide RNA (sgRNA) as described further below). A non-coding guide RNA provided herein can be complementary to a target site (e.g., complementary to either strand of a double-stranded nucleic acid molecule or chromosome at the target site). A "target site" also refers to the location of a polynucleotide sequence within a plant genome that is bound and cleaved by another site-specific nuclease that may not be guided by a non-coding RNA molecule, such as a meganuclease, zinc finger nuclease (ZFN), or a transcription activator-like effector nuclease (TALEN), to introduce a double stranded break (or single-stranded nick) into the polynucleotide sequence and/or its complementary DNA strand. As used herein, a "target region" or a "targeted region" refers to a polynucleotide sequence or region that is flanked by two or more target sites. Without being limiting, in some aspects a target region can be subjected to a mutation, deletion, insertion or inversion. As used herein, "flanked" when used to describe a target region of a polynucleotide sequence or molecule, refers to two or more target sites of the polynucleotide sequence or molecule surrounding the target region, with one target site on each side of the target region.

Apart from genome editing, the term "target site" can also be used in the context of gene suppression to refer to a portion of a mRNA molecule (e.g., a "recognition site") that is complementary to at least a portion of a non-coding RNA molecule (e.g., a miRNA, siRNA, etc.) encoded by a suppression construct. As used herein, a "target site" for a RNA-guided nuclease can comprise the sequence of either complementary strand of a double-stranded nucleic acid (DNA) molecule or chromosome at the target site. It will be appreciated that perfect identity or complementarity may not be required for a non-coding guide RNA to bind or hybridize to a target site. For example, at least 1, at least 2, at least 3, at least 4, at least 5, at least 6, at least 7, or at least 8 mismatches (or more) between a target site and a non-coding RNA can be tolerated.

As used herein, a "donor molecule", "donor template", or "donor template molecule" (collectively a "donor template"), which can be a recombinant DNA donor template, is defined as a nucleic acid molecule having a nucleic acid template or insertion sequence for site-directed, targeted insertion or recombination into the genome of a plant cell via repair of a nick or double-stranded DNA break in the genome of a plant cell. For example, a "donor template" can be used for site-directed integration of a transgene or suppression construct, or as a template to introduce a mutation, such as an insertion, deletion, etc., into a target site within the genome of a plant. A targeted genome editing technique provided herein can comprise the use of one or more, two or more, three or more, four or more, or five or more donor molecules or templates. A donor template can be a single-stranded or double-stranded DNA or RNA molecule or plasmid. A donor template can also have at least one homology sequence or homology arm, such as two homology arms, to direct the integration of a mutation or insertion sequence into a target site within the genome of a plant via homologous recombination, wherein the homology sequence or homology arm(s) are identical or complementary, or have a percent identity or percent complementarity, to a sequence at or near the target site within the genome of the plant. When a donor template comprises homology arm(s) and an insertion sequence, the homology arm(s) will flank or surround the insertion sequence of the donor template. Further, the donor template can be linear or circular, and can be single-stranded or double-stranded. A donor template can be delivered to the cell as a naked nucleic acid (e.g., via particle bombardment), as a complex with one or more delivery agents (e.g., liposomes, proteins, poloxamers, T-strand encapsulated with proteins, etc.), or contained in a bacterial or viral delivery vehicle, such as, for example, *Agrobacterium tumefaciens* or a geminivirus, respectively.

An insertion sequence of a donor template can comprise one or more genes or sequences that each encode a transcribed non-coding RNA or mRNA sequence and/or a translated protein sequence. A transcribed sequence or gene of a donor template can encode a protein or a non-coding RNA molecule. An insertion sequence of a donor template can comprise a polynucleotide sequence that does not comprise a functional gene or an entire gene sequence (e.g., the donor template can simply comprise regulatory sequences, such as a promoter sequence, or only a portion of a gene or coding sequence), or may not contain any identifiable gene expression elements or any actively transcribed gene sequence. An insertion sequence of a donor template provided herein can comprise a transcribable DNA sequence that can be transcribed into an RNA molecule, which can be non-coding and may or may not be operably linked to a promoter and/or other regulatory sequence.

As used herein, the term "guide RNA" or "gRNA" is a short RNA sequence comprising (1) a structural or scaffold RNA sequence necessary for binding or interacting with an RNA-guided nuclease and/or with other RNA molecules (e.g., tracrRNA), and (2) an RNA sequence (referred to herein as a "guide sequence") that is identical or complementary to a target sequence or a target site. A "single-chain guide RNA" (or "sgRNA") is a RNA molecule comprising a crRNA covalently linked a tracrRNA by a linker sequence, which can be expressed as a single RNA transcript or molecule. The guide RNA comprises a guide or targeting sequence (a "guide sequence") that is identical or complementary to a target site within the plant genome, such as at or near a GA oxidase gene. A protospacer-adjacent motif (PAM) can be present in the genome immediately adjacent and upstream to the 5' end of the genomic target site sequence complementary to the targeting sequence of the guide RNA—i.e., immediately downstream (3') to the sense (+) strand of the genomic target site (relative to the targeting sequence of the guide RNA) as known in the art. The genomic PAM sequence on the sense (+) strand adjacent to the target site (relative to the targeting sequence of the guide RNA) can comprise 5'-NGG-3'. However, the corresponding sequence of the guide RNA (i.e., immediately downstream (3') to the targeting sequence of the guide RNA) can generally not be complementary to the genomic PAM sequence. The guide RNA can typically be a non-coding RNA molecule that does not encode a protein.

As used herein, an "RNA-guided nuclease" refers to an RNA-guided DNA endonuclease associated with the CRISPR system. Non-limiting examples of RNA-guided nucleases include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, homologs thereof, or modified versions thereof. In an aspect, the RNA-guided nuclease is Cas9. In an aspect, the RNA-guided nuclease comprises the N and C terminal nuclear localization sequences (NLS).

DESCRIPTION

The present disclosure provides certain stacked combinations of transgenes and/or mutations or edits in corn plants, plant parts, etc., comprising a transgene that encodes one or more CONTANS (CO) or CONSTANS-like (COL) polypeptides, such as *Physcomitrella patens* CONSTANS-like 1 (PpCOL1), in addition to a reduction in the expression level of one or more GA20 and/or GA3 oxidase genes through suppression, mutation and/or editing of the GA oxidase genes, wherein the corn plants have a semi-dwarf phenotype and one or more improved traits related to yield, lodging resistance, and/or stress tolerance. As described in co-pending PCT Application No. PCT/US2017/047405, the entire contents and disclosure of which are incorporated herein by reference, reducing the level of active GAs in corn or other cereal plants, such as through suppression, mutation or editing of one or more GA20 and/or GA3 oxidase genes, can result in a semi-dwarf phenotype with improved agronomic traits, such as lodging resistance and/or increased yield. However, it is proposed herein that lower active GA levels can be combined with an expression cassette or transgene encoding a CONTANS (CO) or CONSTANS-like (COL) protein, such as PpCOL1, to produce a semi-dwarf corn plant having positive ear traits leading to further increased yield, thus providing greater agronomic benefits than either CO/COL expression or lower active GA levels alone.

Gibberellins (gibberellic acids or GAs) are plant hormones that regulate a number of major plant growth and developmental processes. Manipulation of GA levels in semi-dwarf wheat, rice and sorghum plant varieties led to increased yield and reduced lodging in these cereal crops during the 20$^{th}$ century, which was largely responsible for the Green Revolution. However, successful yield gains in other cereal crops, such as corn, have not been realized through manipulation of the GA pathway. Corn or maize is unique among the grain-producing grasses in that it forms separate male (tassel) and female (ear) inflorescences, and mutations in the GA pathway in corn have been shown to negatively impact reproductive development. Indeed, some mutations in the GA pathway genes in corn have been associated with various off-types that are incompatible with yield, which has led researchers away from finding semi-dwarf, high-yielding corn varieties via manipulation of the GA pathway.

Despite these prior difficulties in achieving higher grain yields in corn through manipulation of the GA pathway, co-pending PCT Application No. PCT/US2017/047405 describes a way to manipulate active GA levels in corn plants in a manner that reduces overall plant height and stem internode length and increases resistance to lodging, but does not cause the reproductive off-types previously associated with mutations of the GA pathway in corn. Further evidence indicates that these short stature or semi-dwarf corn plants with reduced GA levels can also have one or more additional yield and/or stress tolerance traits, including increased stem diameter, reduced green snap, deeper roots, increased leaf area, earlier canopy closure, higher stomatal conductance, lower ear height, increased foliar water content, improved drought tolerance, increased nitrogen use efficiency, increased water use efficiency, reduced anthocyanin content and area in leaves under normal or nitrogen or water limiting stress conditions, increased ear weight, increased kernel number, increased kernel weight, increased yield, and/or increased harvest index.

Active or bioactive gibberellic acids (i.e., "active gibberellins" or "active GAs") are known in the art for a given plant species, as distinguished from inactive GAs. For example, active GAs in corn and higher plants include the following: GA1, GA3, GA4, and GA7. Thus, an "active GA-producing tissue" is a plant tissue that produces one or more active GAs.

Certain biosynthetic enzymes (e.g., GA20 oxidase and GA3 oxidase) and catabolic enzymes (e.g., GA2 oxidase) in the GA pathway participate in GA synthesis and degradation, respectively, to affect active GA levels in plant tissues. Thus, in addition to suppression of certain GA20 oxidase genes, it is further proposed that suppression of a GA3 oxidase gene in a constitutive or tissue-specific or tissue-preferred manner can also produce corn plants having a short stature phenotype and increased lodging resistance, with possible increased yield, but without off-types in the ear.

Without being bound by theory, it is proposed that incomplete suppression of GA20 or GA3 oxidase gene(s) and/or targeting of a subset of one or more GA oxidase gene(s) can be effective in achieving a short stature, semi-dwarf phenotype with increased resistance to lodging, but without reproductive off-types in the ear. It is further proposed, without being limited by theory, that restricting the suppression of GA20 and/or GA3 oxidase gene(s) to certain active GA-producing tissues, such as the vascular and/or leaf tissues of the plant, can be sufficient to produce a short-stature plant with increased lodging resistance, but without significant off-types in reproductive tissues. Expression of a GA20 or GA3 oxidase suppression element in a tissue-specific or tissue-preferred manner can be sufficient and effective at producing plants with the short stature phenotype, while avoiding potential off-types in reproductive tissues that were previously observed with GA mutants in corn (e.g., by avoiding or limiting the suppression of the GA20 oxidase gene(s) in those reproductive tissues). For example, GA20 and/or GA3 oxidase gene(s) can be targeted for suppression using a vascular promoter, such as a rice tungro bacilliform virus (RTBV) promoter, that drives expression in vascular tissues of plants. The expression pattern of the RTBV promoter is enriched in vascular tissues of corn plants relative to non-vascular tissues, which is sufficient to produce a semi-dwarf phenotype in corn plants when operably linked to a suppression element targeting GA20 and GA3 oxidase gene(s). Lowering of active GA levels in tissue(s) of a corn plant that produce active GAs can reduce plant height and increase lodging resistance, and off-types can be avoided in those plants if active GA levels are not also significantly impacted or lowered in reproductive tissues, such as the developing female organ or ear of the plant. If active GA levels could be reduced in the stalk, stem, or internode(s) of corn or cereal plants without significantly affecting GA levels in reproductive tissues (e.g., the female or male reproductive organs or inflorescences), then corn or cereal plants having reduced plant height and increased lodging resistance could be created without off-types in the reproductive tissues of the plant.

Without being limited by theory, it is further proposed that short stature, semi-dwarf phenotypes in corn plants can result from a sufficient level of expression of a suppression construct targeting certain GA oxidase gene(s) in active GA-producing tissue(s) of the plant. For targeted suppression of certain GA20 oxidase genes in corn, restricting the pattern of expression to avoid reproductive ear tissues may not be necessary to avoid reproductive off-types in the developing ear. However, expression of a GA20 oxidase suppression construct at low levels, and/or in a limited number of plant tissues, can be insufficient to cause a significant short stature, semi-dwarf phenotype. Given that the observed semi-dwarf phenotype with targeted GA20 oxidase suppression is the result of shortening the stem internodes of the plant, it was surprisingly found that suppression of GA20 oxidase genes in at least some stem tissues was not sufficient to cause shortening of the internodes and reduced plant height. Without being bound by theory, it is proposed that suppression of certain GA oxidase gene(s) in tissue(s) and/or cell(s) of the plant where active GAs are produced, and not necessarily in stem or internode tissue(s), can be sufficient to produce semi-dwarf plants, even though the short stature trait is due to shortening of the stem internodes. Given that GAs can migrate through the vasculature of the plant, manipulating GA oxidase genes in plant tissue(s) where active GAs are produced can result in a short stature, semi-dwarf plant, even though this can be largely achieved by suppressing the level of active GAs produced in non-stem tissues (i.e., away from the site of action in the stem where reduced internode elongation leads to the semi-dwarf phenotype). Indeed, suppression of certain GA20 oxidase genes in leaf tissues causes a moderate semi-dwarf phenotype in corn plants. Given that expression of a GA20 oxidase suppression construct with several different "stem" promoters did not produce the semi-dwarf phenotype in corn, it is noteworthy that expression of the same GA20 oxidase suppression construct with a vascular promoter was effective at consistently producing the semi-dwarf phenotype with a high degree of penetrance across events and germplasms. A semi-dwarf phenotype was also observed with expression of the same GA20 oxidase suppression construct using other vascular promoters and with various constitutive promoters without any observable off-types.

By targeting a subset of one or more endogenous GA3 or GA20 oxidase genes for suppression within a plant, a more pervasive pattern of expression (e.g., with a constitutive promoter) can be used to produce semi-dwarf plants without significant reproductive off-types and/or other undesirable traits in the plant, even with expression of the suppression construct in reproductive tissue(s). Indeed, suppression elements and constructs are provided herein that selectively target the GA20 oxidase_3 and/or GA20 oxidase_5 genes for suppression, which can be operably linked to a vascular, leaf and/or constitutive promoter.

Thus, recombinant DNA constructs and modified corn plants are provided herein comprising a GA20 or GA3 oxidase suppression element or sequence operably linked to a plant expressible promoter, which can be a constitutive or tissue-specific or tissue-preferred promoter. Such a tissue-specific or tissue-preferred promoter can drive expression of its associated GA oxidase suppression element or sequence in one or more active GA-producing tissue(s) of the plant to suppress or reduce the level of active GAs produced in those tissue(s). Such a tissue-specific or tissue-preferred promoter can drive expression of its associated GA oxidase suppression construct or transgene during one or more vegetative stage(s) of development. Such a tissue-specific or tissue-preferred promoter can also have little or no expression in one or more cell(s) or tissue(s) of the developing female organ or ear of the plant to avoid the possibility of off-types in those reproductive tissues. According to an aspect, the tissue-specific or tissue-preferred promoter is a vascular promoter, such as the RTBV promoter. The sequence of the RTBV promoter is provided herein as SEQ ID NO: 65, and a truncated version of the RTBV promoter is further provided herein as SEQ ID NO: 66. However, other types of tissue-specific or tissue preferred promoters can potentially be used for GA3 oxidase suppression in active GA-producing tissues of a corn or cereal plant to produce a semi-dwarf phenotype without significant off-types. As introduced above, instead of suppressing one or more GA oxidase gene(s), active GA levels can also be reduced in a corn plant by mutation or editing of one or more GA20 and/or GA3 oxidase gene(s).

Corn has a family of at least nine GA20 oxidase genes that includes GA20 oxidase_1, GA20 oxidase 2, GA20 oxidase 3, GA20 oxidase 4, GA20 oxidase 5, GA20 oxidase 6, GA20 oxidase_7, GA20 oxidase_8, and GA20 oxidase_9. However, there are only two GA3 oxidases in corn, GA3 oxidase_1 and GA3 oxidase_2. The DNA and protein sequences by SEQ ID NOs for each of these GA20 oxidase genes are provided in Table 1, and the DNA and protein sequences by SEQ ID NOs for each of these GA3 oxidase genes are provided in Table 2.

TABLE 1

DNA and protein sequences by sequence identifier for GA20 oxidase genes in corn.

| GA20 oxidase Gene | cDNA | Coding Sequence (CDS) | Protein |
| --- | --- | --- | --- |
| GA20 oxidase_1 | SEQ ID NO: 1 | SEQ ID NO: 2 | SEQ ID NO: 3 |
| GA20 oxidase_2 | SEQ ID NO: 4 | SEQ ID NO: 5 | SEQ ID NO: 6 |
| GA20 oxidase_3 | SEQ ID NO: 7 | SEQ ID NO: 8 | SEQ ID NO: 9 |
| GA20 oxidase_4 | SEQ ID NO: 10 | SEQ ID NO: 11 | SEQ ID NO: 12 |
| GA20 oxidase_5 | SEQ ID NO: 13 | SEQ ID NO: 14 | SEQ ID NO: 15 |
| GA20 oxidase_6 | SEQ ID NO: 16 | SEQ ID NO: 17 | SEQ ID NO: 18 |
| GA20 oxidase_7 | SEQ ID NO: 19 | SEQ ID NO: 20 | SEQ ID NO: 21 |
| GA20 oxidase_8 | SEQ ID NO: 22 | SEQ ID NO: 23 | SEQ ID NO: 24 |
| GA20 oxidase_9 | SEQ ID NO: 25 | SEQ ID NO: 26 | SEQ ID NO: 27 |

TABLE 2

DNA and protein sequences by sequence identifier for GA3 oxidase genes in corn.

| GA3 oxidase Gene | cDNA | Coding Sequence (CDS) | Protein |
| --- | --- | --- | --- |
| GA3 oxidase_1 | SEQ ID NO: 28 | SEQ ID NO: 29 | SEQ ID NO: 30 |
| GA3 oxidase_2 | SEQ ID NO: 31 | SEQ ID NO: 32 | SEQ ID NO: 33 |

In addition to lowering active GA levels in corn plants through suppression, mutation or editing of GA oxidase gene(s), such corn plants as provided herein can further comprise an ectopically expressed CONSTANS (CO) or CONSTANS-like (COL) transgene. CONSTANS (CO) and its paralogous CONSTANS-like (COL) polypeptides are transcriptional regulators of the photoperiodic control of flowering in plants. In *Arabidopsis*, the CO gene, when mutated, delayed the flowering under long days, which is the inductive condition for flowering in this species. See Putterill et al., "The CO gene of *Arabidopsis* promotes flowering and encodes a protein showing similarities to zinc finger transcription factors," *Cell*, 80: 847-857 (1995). While not being limited by any scientific theory, CO protein expression is believed to be modulated by the circadian clock and day length to control flowering. See Suarez-Lopez et al., "CONSTANS mediates between the circadian clock and the control of flowering in *Arabidopsis*," *Nature*, 410: 1116-1120 (2001).

CO and COL are both zinc-finger transcription factors with characteristic domains and are found in monocot and dicot plant species. The N-terminal part of CO and COL proteins typically contain one or two tandem Zn finger domain(s), which are also called B-boxes involved in protein-protein interaction, and a C-terminal CCT (CO, CO-like, TOC1) domain, which can also include a nuclear import signal. See Khanna et al., "The *Arabidopsis* B-box zinc finger family," *Plant Cell*, 21:3416-3420 (2009); see also Robson et al., "Functional importance of conserved domains in the flowering-time gene CONSTANS demonstrated by analysis of mutant alleles and transgenic plants," *Plant J.*, 28:619-631 (2001). In addition to one or two B-boxes and the CCT domain, the CO and COL proteins can also contain a conserved six-amino acid motif (G-I/V-V-P-S/T-F) in their C-termini. See Datta et al., "*Arabidopsis* CONSTANS-LIKE3 is a positive regulator of red light signaling and root growth," *Plant Cell*, 18: 70-84 (2006).

*Physcomitrella patens* CONSTANS-like 1 (PpCOL1) is a zinc finger transcription factor derived from the *Physcomitrella patens* moss species. The expression of PpCOL1 is shown to be photoperiodically regulated in this moss species, suggesting a role for PpCOL1 in the photoperiodic control of reproduction. See Shimizu et al., "Photoperiod-regulated expression of the PpCOL1 gene encoding a homolog of CO/COL protein in the moss *Physcomitrella patens*,". *Biochem. Biophys. Res. Commun.*, 324:1296-1301 (2004). Transgenic expression of PpCOL1 in corn plants has been shown to improve drought, salt, and/or cold tolerance. See U.S. Pat. No. 7,439,417. Transgenic expression of the PpCOL1 gene in corn plants also improves ear traits or metrics, such as single kernel weight, ear area, ear size, ear weight, and grain yield estimate.

The CONSTANS (CO) or CONSTANS-like (COL) transgene can comprise a coding sequence of any known CO or COL gene expected to have a similar function to PpCOL1. The CO/COL transgene can be a Group I, Group II, or Group III CONSTANS (CO) or CONSTANS-like (COL) gene. See, e.g., Cai, D et al., "Identification and characterization of CONSTANS-like (COL) gene family in upland cotton (*Gossypium hirsutum*)", PLOS ONE 12(6): e0179038, the entire contents and disclosure of which are incorporated by reference. The CO/COL transgene can comprise one or two B-box domain(s), a CCT domain, and possibly an additional VP motif and/or a diverged zinc-finger. See also, e.g., Khanna et al., "The *Arabidopsis* B-Box Zinc Finger Family," *Plant Cell* 21(11): 3416-3420 (2009), the entire contents and disclosure of which are incorporated by reference. In an aspect, a CO or COL polypeptide of the present disclosure is a *Physcomitrella patens* COL (PpCOL) polypeptide or homologs, orthologs, and/or paralogs thereof. In an aspect, a CO or COL polynucleotide provided herein comprises an amino acid sequence comprising SEQ ID NOs: 168, and homologs, orthologs, and paralogs thereof. In another aspect, a CO or COL polynucleotide provided herein comprises an amino acid sequence selected from the group consisting of SEQ ID NOs: 176-452, and homologs, orthologs, and paralogs thereof.

According to an aspect, a modified corn plant or plant part is provided comprising (1) a first expression cassette comprising a transcribable DNA sequence encoding a non-coding RNA for suppression of one or more GA20 oxidase genes and/or one or more GA3 oxidase genes, and (2) a second expression cassette comprising a DNA sequence encoding a CONSTANS (CO) or CONSTANS-like (COL) polypeptide. Alternatively, a modified corn plant or plant part is provided comprising (1) one or more mutated or edited GA20 oxidase genes and/or one or more mutated or edited GA3 oxidase genes, and (2) an expression cassette comprising a DNA sequence encoding a CONSTANS (CO) or CONSTANS-like (COL) polypeptide.

According to another aspect, a modified corn plant or a plant part thereof is provided comprising 1) a first recombinant expression cassette (or a construct) comprising a transcribable DNA sequence encoding a non-coding RNA for suppression of one or more gibberellic acid 20 (GA20) oxidase genes and/or one or more gibberellic acid 3 (GA3) oxidase genes, and 2) a second recombinant expression cassette (or a construct) comprising a DNA sequence encoding a CONSTANS (CO) or CONSTANS-like (COL) polypeptide.

According to another aspect, a plurality of modified corn plants in a field, each modified corn plant comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, and 2) a second recombinant expression cassette comprising a DNA sequence encoding a CONSTANS (CO) or CONSTANS-like (COL) polypeptide. In an aspect, the modified corn plants have increased yield relative to control corn plants. In another aspect, the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

Such modified corn plants can have semi-dwarf plant height in addition to one or more improved yield-related traits as described further herein, relative to control corn plant(s) that do not have the first and second expression cassettes or the combination of CO/COL transgene and edited/mutated GA oxidase gene(s). Modified corn plants comprising a combination of the first and second expression cassettes, or a combination of an expression cassette comprising a CO or COL transgene and one or more mutated or edited GA oxidase genes, can each be referred to as a "stack" or "stacked" combination. Such stacked combinations for the reduction of active GA levels and expression of a CO/COL transgene can be brought together in the same corn plant, or population of corn plants, by (1) crossing a first plant comprising a GA oxidase suppression element(s), edit(s) and/or mutation(s) to a second plant comprising a CO/COL transgene, (2) co-transformation of a plant or plant part with a GA oxidase suppression element(s) and a CO/COL transgene, (3) transformation of a plant or plant part already having a GA oxidase suppression element(s), edit(s) and/or mutation(s) with a CO/COL transgene, (4) transformation of a plant or plant part already having a CO/COL transgene with a GA oxidase suppression element(s), or (5) editing or mutating a GA oxidase gene(s) in a plant or plant part already having a CO/COL transgene, each of which can be followed by further crosses to obtain a desired genotype, plant parts can be regenerated, grown or developed into plants, and plant parts can be taken from any of the foregoing plants.

As provided above, a corn plant or plant part can comprise a first expression cassette comprising a first sequence encoding a non-coding RNA molecule that targets one or more GA20 or GA3 oxidase gene(s) for suppression. In an aspect, the non-coding RNA molecule can target one or more GA20 oxidase gene(s) for suppression, such as a GA20 oxidase_3 gene, a GA20 oxidase_4 gene, a GA20 oxidase_5 gene, or any combination thereof. According to an aspect, the first expression cassette comprises a first transcribable DNA sequence encoding a non-coding RNA targeting a GA20 oxidase_3 gene for suppression. According to another aspect, the first expression cassette comprises a first transcribable DNA sequence encoding a non-coding RNA targeting a GA20 oxidase_5 gene for suppression. According to another aspect, the first expression cassette comprises a first transcribable DNA sequence encoding a non-coding RNA that targets both the GA20 oxidase_3 gene and the GA20 oxidase_5 gene for suppression. In addition to targeting a mature mRNA sequence (including either or both of the untranslated or exonic sequences), a non-coding RNA molecule can also target the intronic sequences of a GA20 oxidase gene or transcript.

A genomic DNA sequence of GA20 oxidase_3 is provided in SEQ ID NO: 34, and the genomic DNA sequence of GA20 oxidase_5 is provided in SEQ ID NO: 35. For the GA20 oxidase_3 gene, SEQ ID NO: 34 provides 3000 nucleotides upstream of the GA20 oxidase_3 5'-UTR; nucleotides 3001-3096 correspond to the 5'-UTR; nucleotides 3097-3665 correspond to the first exon; nucleotides 3666-3775 correspond to the first intron; nucleotides 3776-4097 correspond to the second exon; nucleotides 4098-5314 correspond to the second intron; nucleotides 5315-5584 correspond to the third exon; and nucleotides 5585-5800 correspond to the 3'-UTR. SEQ ID NO: 34 also provides 3000 nucleotides downstream of the end of the 3'-UTR (nucleotides 5801-8800). For the GA20 oxidase_5 gene, SEQ ID NO: 35 provides 3000 nucleotides upstream of the GA20 oxidase_5 start codon (nucleotides 1-3000); nucleotides 3001-3791 correspond to the first exon; nucleotides 3792-3906 correspond to the first intron; nucleotides 3907-4475 correspond to the second exon; nucleotides 4476-5197 correspond to the second intron; nucleotides 5198-5473 correspond to the third exon; and nucleotides 5474-5859 correspond to the 3'-UTR. SEQ ID NO: 35 also provides 3000 nucleotides downstream of the end of the 3'-UTR (nucleotides 5860-8859).

A genomic DNA sequence of GA20 oxidase_4 is provided in SEQ ID NO: 38. For the GA oxidase_4 gene, SEQ ID NO: 38 provides nucleotides 1-1416 upstream of the 5'-UTR; nucleotides 1417-1543 of SEQ ID NO: 38 correspond to the 5'-UTR; nucleotides 1544-1995 of SEQ ID NO: 38 correspond to the first exon; nucleotides 1996-2083 of SEQ ID NO: 38 correspond to the first intron; nucleotides 2084-2411 of SEQ ID NO: 38 correspond to the second exon; nucleotides 2412-2516 of SEQ ID NO: 38 correspond to the second intron; nucleotides 2517-2852 of SEQ ID NO: 38 correspond to the third exon; nucleotides 2853-3066 of SEQ ID NO: 38 correspond to the 3'-UTR; and nucleotides 3067-4465 of SEQ ID NO: 38 corresponds to genomic sequence downstream of to the 3'-UTR.

For the GA20 oxidase_5 gene, SEQ ID NO: 35 provides 3000 nucleotides upstream of the GA20 oxidase_5 start codon (nucleotides 1-3000); nucleotides 3001-3791 correspond to the first exon; nucleotides 3792-3906 correspond to the first intron; nucleotides 3907-4475 correspond to the second exon; nucleotides 4476-5197 correspond to the second intron; nucleotides 5198-5473 correspond to the third exon; and nucleotides 5474-5859 correspond to the 3'-UTR. SEQ ID NO: 35 also provides 3000 nucleotides downstream of the end of the 3'-UTR (nucleotides 5860-8859).

For suppression of a GA20 oxidase_3 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 7 and 8.

For suppression of a GA20 oxidase_4 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 10 and 11.

For suppression of a GA20 oxidase_5 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 13 and 14.

For suppression of a GA20 oxidase_3 gene and a GA20 oxidase_5 gene, a transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 7 and 8; and the transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 13 and 14.

In an aspect, a non-coding RNA molecule encoded by a transcribable DNA sequence comprises (i) a sequence that is at least 95%, at least 96%, at least 97%, at least 98%, at least 99%, at least 99.5%, or 100% complementary to SEQ ID NO: 39, 41, 43 or 45, and/or (ii) a sequence or suppression element encoding a non-coding RNA molecule comprising a sequence that is at least 95%, at least 96%, at least 97%, at least 98%, at least 99%, at least 99.5%, or 100% identical to SEQ ID NO: 40, 42, 44 or 46. According to an aspect, the non-coding RNA molecule encoded by a transcribable DNA sequence can comprise a sequence with one or more mismatches, such as 1, 2, 3, 4, 5 or more complementary mismatches, relative to the sequence of a target or recognition site of a targeted GA20 oxidase gene mRNA, such as a sequence that is nearly complementary to SEQ ID NO: 40 but with one or more complementary mismatches relative to SEQ ID NO: 40. According to a particular aspect, the non-coding RNA molecule encoded by the transcribable DNA sequence comprises a sequence that is 100% identical to SEQ ID NO: 40, which is 100% complementary to a target sequence within the cDNA and coding sequences of the GA20 oxidase_3 (i.e., SEQ ID NOs: 7 and 8, respectively), and/or to a corresponding sequence of a mRNA encoded by an endogenous GA20 oxidase_3 gene. However, the sequence of a non-coding RNA molecule encoded by a transcribable DNA sequence that is 100% identical to SEQ ID NO: 40, 42, 44 or 46 may not be perfectly complementary to a target sequence within the cDNA and coding sequences of the GA20 oxidase_5 gene (i.e., SEQ ID NOs: 13 and 14, respectively), and/or to a corresponding sequence of a mRNA encoded by an endogenous GA20 oxidase_5 gene. For example, the closest complementary match between the non-coding RNA molecule or miRNA sequence in SEQ ID NO: 40 and the cDNA and coding sequences of the GA20 oxidase_5 gene can include one mismatch at the first position of SEQ ID NO: 39 (i.e., the "C" at the first position of SEQ ID NO: 39 is replaced with a "G"; i.e., GTCCATCATGCGGTGCAACTA). However, the non-coding RNA molecule or miRNA sequence in SEQ ID NO: 40 can still bind and hybridize to the mRNA encoded by the endogenous GA20 oxidase_5 gene despite this slight mismatch.

For suppression of a GA20 oxidase_1 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 1 and 2.

For suppression of a GA20 oxidase_2 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 4 and 5.

For suppression of a GA2 oxidase 6, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 16 and 17.

For suppression of a GA20 oxidase 7 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 19 and 20.

For suppression of a GA20 oxidase_8 gene, a first transcribable DNA sequence comprises a sequence that is at least at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 22 and 23.

For suppression of a GA20 oxidase_9 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 25 and 26.

A non-coding RNA can target an intron sequence of a GA20 oxidase gene instead of, or in addition to, an exonic, 5' UTR or 3' UTR of the GA20 oxidase gene. Thus, a non-coding RNA targeting the GA20 oxidase_3 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 34, and/or of nucleotides 3666-3775 or 4098-5314 of SEQ ID NO: 34.

In another aspect, a non-coding RNA molecule targeting the GA20 oxidase_5 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 35, and/or of nucleotides 3792-3906 or 4476-5197 of SEQ ID NO: 35.

In another aspect, a non-coding RNA molecule targeting the GA20 oxidase_4 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 38, and/or of nucleotides 1996-2083 or 2412-2516 of SEQ ID NO: 38.

In another aspect, a first expression cassette comprises a first transcribable DNA sequence encoding a non-coding RNA targeting a GA3 oxidase gene(s) for suppression in corn, such as a GA3 oxidase_1 gene or a GA3 oxidase_2 gene. In another aspect, a first transcribable DNA sequence encoding a non-coding RNA targets both the GA3 oxidase_1 gene and the GA3 oxidase_2 gene for suppression. In addition to targeting a mature mRNA sequence (including either or both of the untranslated or exonic sequences), a non-coding RNA molecule can also target the intronic sequences of a GA3 oxidase gene or transcript.

The genomic DNA sequence of GA3 oxidase_1 is provided in SEQ ID NO: 36, and the genomic DNA sequence of GA3 oxidase_2 is provided in SEQ ID NO: 37. For the GA3 oxidase_1 gene, nucleotides 1-29 of SEQ ID NO: 36 correspond to the 5'-UTR; nucleotides 30-514 of SEQ ID NO: 36 correspond to the first exon; nucleotides 515-879 of SEQ ID NO: 36 correspond to the first intron; nucleotides 880-1038 of SEQ ID NO: 36 correspond to the second exon; nucleotides 1039-1158 of SEQ ID NO: 36 correspond to the second intron; nucleotides 1159-1663 of SEQ ID NO: 36 correspond to the third exon; and nucleotides 1664-1788 of SEQ ID NO: 36 correspond to the 3'-UTR. For the GA3 oxidase_2 gene, nucleotides 1-38 of SEQ ID NO: 37 correspond to the 5-UTR; nucleotides 39-532 of SEQ ID NO: 37 correspond to the first exon; nucleotides 533-692 of SEQ ID NO: 37 correspond to the first intron; nucleotides 693-851 of SEQ ID NO: 37 correspond to the second exon; nucleotides 852-982 of SEQ ID NO: 37 correspond to the second intron; nucleotides 983-1445 of SEQ ID NO: 37 correspond to the third exon; and nucleotides 1446-1698 of SEQ ID NO: 37 correspond to the 3'-UTR.

For suppression of a GA3 oxidase_1 gene, a first transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 28 and 29.

As mentioned above, a non-coding RNA molecule can target an intron sequence of a GA3 oxidase gene instead of, or in addition to, an exonic, 5' UTR or 3' UTR of the GA oxidase gene. Thus, a non-coding RNA molecule targeting the GA3 oxidase_1 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 36, and/or of nucleotides 515-879 or 1039-1158 of SEQ ID NO: 36.

For suppression of a GA3 oxidase_2 gene, a first transcribable DNA sequence comprises a sequence that is at least at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 31 and 32.

As mentioned above, a non-coding RNA molecule can target an intron sequence of a GA3 oxidase gene instead of, or in addition to, an exonic, 5' UTR or 3' UTR of the GA3 oxidase gene. Thus, a non-coding RNA molecule targeting the GA3 oxidase_2 gene for suppression can comprise a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 37, and/or of nucleotides 533-692 or 852-982 of SEQ ID NO: 37.

For suppression of a GA3 oxidase_1l gene and a GA3 oxidase_2 gene, a transcribable DNA sequence comprises a sequence that is at least at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 28 and 29; and the transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 51, at least 52, at least 53, at least 54, at least 55, at least 56, at least 57, at least 58, at least 59, or at least 60 consecutive nucleotides of a sequence as set forth in SEQ ID NOs: 31 and 32.

In an aspect, a transcribable DNA sequence for the suppression of a GA20 oxidase gene and/or a GA3 oxidase comprises a sequence selected from the group consisting of SEQ ID NOs: 47, 49, 51, 53, 55, 57, 59, 61, and 63. In another aspect, a transcribable DNA sequence for the suppression of a GA20 oxidase gene and/or a GA3 oxidase encodes a non-coding RNA sequence, wherein the non-coding RNA sequence comprises a sequence selected from the group consisting of SEQ ID NOs: 48, 50, 52, 54, 56, 58, 60, 62, and 64.

In an aspect, an expression cassette is provided comprising a second DNA sequence encoding a CO or COL polypeptide. In another aspect, the second DNA sequence encodes a protein that comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to an amino acid sequence selected from the group consisting of SEQ ID NOs: 176-397. In another aspect, the second DNA sequence encodes a protein that comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to an amino acid sequence selected from the group consisting of SEQ ID NOs: 398-452. The second DNA sequence encoding a CO or COL polypeptide is operatively linked to a constitutive or tissue-specific promoter.

In an aspect, an expression cassette is provided comprising a second DNA sequence encoding PpCOL1. In another aspect, the second DNA sequence comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NO: 169. In another aspect, the second DNA sequence comprises a sequence encoding a polypeptide that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168, or a functional fragment thereof.

In addition to targeting a mature mRNA sequence, a non-coding RNA molecule can instead target an intronic sequence of a GA oxidase gene or mRNA transcript, or a GA oxidase mRNA sequence overlapping coding and non-coding sequences. According to other aspects, a recombinant DNA molecule, vector or construct is provided comprising a transcribable DNA sequence encoding a non-coding RNA (precursor) molecule that is cleaved or processed into a mature non-coding RNA molecule that binds or hybridizes to a target mRNA in a plant cell, wherein the target mRNA molecule encodes a GA20 or GA3 oxidase protein, and wherein the transcribable DNA sequence is operably linked to a constitutive or tissue-specific or tissue-preferred promoter.

Any method known in the art for suppression of a target gene can be used to suppress GA oxidase gene(s) according to aspects of the present disclosure including expression of antisense RNAs, double stranded RNAs (dsRNAs) or inverted repeat RNA sequences, or via co-suppression or RNA interference (RNAi) through expression of small interfering RNAs (siRNAs), short hairpin RNAs (shRNAs), trans-acting siRNAs (ta-siRNAs), or micro RNAs (miRNAs). Furthermore, sense and/or antisense RNA molecules can be used that target the non-coding genomic sequences or regions within or near a gene to cause silencing of the gene. Accordingly, any of these methods can be used for the targeted suppression of an endogenous GA oxidase gene(s) in a tissue-specific or tissue-preferred manner. See, e.g., U.S. Patent Application Publication Nos. 2009/0070898, 2011/0296555, and 2011/0035839, the contents and disclosures of which are incorporated herein by reference.

In an aspect, an expression level(s) of one or more endogenous GA20 oxidase and/or GA3 oxidase gene(s) is/are reduced or eliminated in the modified corn plant, thereby suppressing the endogenous GA20 oxidase and/or GA3 oxidase gene(s).

According to an aspect, a modified or transgenic plant is provided having the expression level(s) of one or more GA20 oxidase gene(s) reduced in at least one plant tissue by at least 5%, at least 10%, at least 20%, at least 25%, at least 30%, at least 40%, at least 50%, at least 60%, at least 70%, at least 75%, at least 80%, at least 90%, or 100%, as compared to a control plant.

According to an aspect, a modified or transgenic plant is provided having the expression level(s) of one or more GA3 oxidase gene(s) reduced in at least one plant tissue by at least 5%, at least 10%, at least 20%, at least 25%, at least 30%, at least 40%, at least 50%, at least 60%, at least 70%, at least 75%, at least 80%, at least 90%, or 100%, as compared to a control plant.

According to an aspect, a modified or transgenic plant is provided having the expression level(s) of one or more GA20 oxidase gene(s) reduced in at least one plant tissue by 5%-20%, 5%-25%, 5%-30%, 5%-40%, 5%-50%, 5%-60%, 5%-70%, 5%-75%, 5%-80%, 5%-90%, 5%-100%, 75%-100%, 50%-100%, 50%-90%, 50%-75%, 25%-75%, 30%-80%, or 10%-75%, as compared to a control plant.

According to an aspect, a modified or transgenic plant is provided having the expression level(s) of one or more GA3 oxidase gene(s) reduced in at least one plant tissue by 5%-20%, 5%-25%, 5%-30%, 5%-40%, 5%-50%, 5%-60%, 5%-70%, 5%-75%, 5%-80%, 5%-90%, 5%-100%, 75%-100%, 50%-100%, 50%-90%, 50%-75%, 25%-75%, 30%-80%, or 10%-75%, as compared to a control plant.

According to an aspect, the at least one tissue of a modified or transgenic plant having a reduced expression level of a GA20 oxidase and/or GA3 oxidase gene(s) includes one or more active GA producing tissue(s) of the plant, such as the vascular and/or leaf tissue(s) of the plant, during one or more vegetative stage(s) of development.

In an aspect, the non-coding RNA is a precursor miRNA or siRNA capable of being processed or cleaved to form a mature miRNA or siRNA.

In an aspect, suppression of an endogenous GA20 oxidase gene or a GA3 oxidase gene is tissue-specific (e.g., only in leaf and/or vascular tissue). Suppression of a GA20 oxidase gene can be constitutive and/or vascular or leaf tissue specific or preferred. In other aspects, suppression of a GA20 oxidase gene or a GA3 oxidase gene is constitutive and not tissue-specific. According to an aspect, expression of an endogenous GA20 oxidase gene and/or a GA3 oxidase gene is reduced in one or more tissue types (e.g., in leaf and/or vascular tissue(s)) of a modified or transgenic plant as compared to the same tissue(s) of a control plant.

Engineered miRNAs can be useful for targeted gene suppression with increased specificity. See, e.g., Parizotto et al., *Genes Dev.* 18:2237-2242 (2004), and U.S. Patent Application Publication Nos. 2004/0053411, 2004/0268441, 2005/0144669, and 2005/0037988, the contents and disclosures of which are incorporated herein by reference. miRNAs are non-protein coding RNAs. When a miRNA precursor molecule is cleaved, a mature miRNA is formed that is typically from about 19 to about 25 nucleotides in length (commonly from about 20 to about 24 nucleotides in length in plants), such as 19, 20, 21, 22, 23, 24, or 25 nucleotides in length, and has a sequence corresponding to the gene targeted for suppression and/or its complement. Mature miRNA hybridizes to target mRNA transcripts and guides the binding of a complex of proteins to the target transcripts, which can function to inhibit translation and/or result in degradation of the transcript, thus negatively regulating or suppressing expression of the targeted gene. miRNA precursors are also useful in plants for directing in-phase production of siRNAs, trans-acting siRNAs (ta-siRNAs), in a process that requires a RNA-dependent RNA polymerase to cause suppression of a target gene. See, e.g., Allen et al., *Cell*, 121:207-221 (2005), Vaucheret, *Science STKE*, 2005: pe43 (2005), and Yoshikawa et al. *Genes Dev.*, 19:2164-2175 (2005), the contents and disclosures of which are incorporated herein by reference.

Without being limited by any scientific theory, plant miRNAs regulate their target genes by recognizing and binding to a complementary or near-perfectly complementary sequence (miRNA recognition site) in the target mRNA transcript, followed by cleavage of the transcript by RNase III enzymes, such as ARGONAUTE1. In plants, certain mismatches between a given miRNA recognition site and the corresponding mature miRNA are typically not tolerated, particularly mismatched nucleotides at positions 10 and 11 of the mature miRNA. Positions within the mature miRNA are given in the 5' to 3' direction. Perfect complementarity between a given miRNA recognition site and the corresponding mature miRNA is usually required at positions 10 and 11 of the mature miRNA. See, for example, Franco-Zorrilla et al. (2007) *Nature Genetics*, 39:1033-1037; and Axtell et al. (2006) *Cell*, 127:565-577.

Many microRNA genes (MIR genes) have been identified and made publicly available in a database ("miRBase", available on line at microrna.sanger.ac.uk/sequences; also see Griffiths-Jones et al. (2003) *Nucleic Acids Res.*, 31:439-441). MIR genes have been reported to occur in intergenic regions, both isolated and in clusters in the genome, but can also be located entirely or partially within introns of other genes (both protein-coding and non-protein-coding). For a review of miRNA biogenesis, see Kim (2005) *Nature Rev. Mol. Cell. Biol.*, 6:376-385. Transcription of MIR genes can be, at least in some cases, under promotional control of a MIR gene's own promoter. The primary transcript, termed a "pri-miRNA", can be quite large (several kilobases) and can be polycistronic, containing one or more pre-miRNAs (fold-back structures containing a stem-loop arrangement that is processed to the mature miRNA) as well as the usual 5' "cap" and polyadenylated tail of an mRNA. See, for example, FIG. 1 in Kim (2005) *Nature Rev. Mol. Cell. Biol.*, 6:376-385.

Transgenic expression of miRNAs (whether a naturally occurring sequence or an artificial sequence) can be employed to regulate expression of the miRNA's target gene or genes. Recognition sites of miRNAs have been validated in all regions of a mRNA, including the 5' untranslated region, coding region, intron region, and 3' untranslated region, indicating that the position of the miRNA target or recognition site relative to the coding sequence may not necessarily affect suppression (see, e.g., Jones-Rhoades and Bartel (2004). *Mol. Cell*, 14:787-799, Rhoades et al. (2002) *Cell*, 110:513-520, Allen et al. (2004) *Nat. Genet.*, 36:1282-1290, Sunkar and Zhu (2004) *Plant Cell*, 16:2001-2019). miRNAs are important regulatory elements in eukaryotes, and transgenic suppression with miRNAs is a useful tool for manipulating biological pathways and responses. A description of native miRNAs, their precursors, recognition sites, and promoters is provided in U.S. Patent Application Publication No. 2006/0200878, the contents and disclosures of which are incorporated herein by reference.

Designing an artificial miRNA sequence can be achieved by substituting nucleotides in the stem region of a miRNA precursor with a sequence that is complementary to the intended target, as demonstrated, for example, by Zeng et al. (2002) *Mol. Cell*, 9:1327-1333. According to many aspects, the target can be a sequence of a GA20 oxidase gene or a GA3 oxidase gene. One non-limiting example of a general method for determining nucleotide changes in a native miRNA sequence to produce an engineered miRNA precursor for a target of interest includes the following steps: (a)

selecting a unique target sequence of at least 18 nucleotides specific to the target gene, e.g., by using sequence alignment tools such as BLAST (see, for example, Altschul et al. (1990) *J. Mol. Biol.*, 215:403-410; Altschul et al. (1997) *Nucleic Acids Res.*, 25:3389-3402); cDNA and/or genomic DNA sequences can be used to identify target transcript orthologues and any potential matches to unrelated genes, thereby avoiding unintentional silencing or suppression of non-target sequences; (b) analyzing the target gene for undesirable sequences (e.g., matches to sequences from non-target species), and score each potential target sequence for GC content, Reynolds score (see Reynolds et al. (2004) *Nature Biotechnol.*, 22:326-330), and functional asymmetry characterized by a negative difference in free energy ("ΔΔG") (see Khvorova et al. (2003) *Cell*, 115:209-216). Preferably, target sequences (e.g., 19-mers) can be selected that have all or most of the following characteristics: (1) a Reynolds score >4, (2) a GC content between about 40% to about 60%, (3) a negative ΔΔG, (4) a terminal adenosine, (5) lack of a consecutive run of 4 or more of the same nucleotide; (6) a location near the 3' terminus of the target gene; (7) minimal differences from the miRNA precursor transcript. In an aspect, a non-coding RNA molecule used here to suppress a target gene (e.g., a GA20 or GA3 oxidase gene) is designed to have a target sequence exhibiting one or more, two or more, three or more, four or more, or five or more of the foregoing characteristics. Positions at every third nucleotide of a suppression element can be important in influencing RNAi efficacy; for example, an algorithm, "siExplorer" is publicly available at ma.chem.t.u-tokyo.ac.j p/siexplorer.htm (see Katoh and Suzuki (2007) *Nucleic Acids Res.*, 10.1093/nar/gkl1120); (c) determining a reverse complement of the selected target sequence (e.g., 19-mer) to use in making a modified mature miRNA. Relative to a 19-mer sequence, an additional nucleotide at position 20 can be matched to the selected target or recognition sequence, and the nucleotide at position 21 can be chosen to either be unpaired to prevent spreading of silencing on the target transcript or paired to the target sequence to promote spreading of silencing on the target transcript; and (d) transforming the artificial miRNA into a plant.

Multiple sense and/or anti-sense suppression elements for more than one GA oxidase target can be arranged serially in tandem or arranged in tandem segments or repeats, such as tandem inverted repeats, which can also be interrupted by one or more spacer sequence(s), and the sequence of each suppression element can target one or more GA oxidase gene(s). Furthermore, a sense or anti-sense sequence of the suppression element may not be perfectly matched or complementary to the targeted GA oxidase gene sequence, depending on the sequence and length of the suppression element. Even shorter RNAi suppression elements from about 19 nucleotides to about 27 nucleotides in length can have one or more mismatches or non-complementary bases, yet still be effective at suppressing the target GA oxidase gene. Accordingly, a sense or anti-sense suppression element sequence can be at least 80%, at least 85%, at least 90%, at least 95%, at least 96%, at least 97%, at least 98%, at least 99%, at least 99.5% or 100% identical to a corresponding sequence of at least a segment or portion of the targeted GA oxidase gene, or its complementary sequence, respectively.

For suppression of GA oxidase gene(s) using an inverted repeat or a transcribed dsRNA, a transcribable DNA sequence or suppression element can comprise a sense sequence that comprises a segment or portion of a targeted GA oxidase gene and an anti-sense sequence that is complementary to a segment or portion of the targeted GA oxidase gene, where the sense and anti-sense DNA sequences are arranged in tandem. The sense and/or anti-sense sequences, respectively, can each be less than 100% identical or complementary to a segment or portion of the targeted GA oxidase gene as described above. A sense and anti-sense sequences can be separated by a spacer sequence, such that the RNA molecule transcribed from the suppression element forms a stem, loop or stem-loop structure between the sense and anti-sense sequences. A suppression element can instead comprise multiple sense and anti-sense sequences that are arranged in tandem, which can also be separated by one or more spacer sequences. Suppression elements comprising multiple sense and anti-sense sequences can be arranged as a series of sense sequences followed by a series of anti-sense sequences, or as a series of tandemly arranged sense and anti-sense sequences. Alternatively, one or more sense DNA sequences can be expressed separately from the one or more anti-sense sequences (i.e., one or more sense DNA sequences can be expressed from a first transcribable DNA sequence, and one or more anti-sense DNA sequences can be expressed from a second transcribable DNA sequence, wherein the first and second transcribable DNA sequences are expressed as separate transcripts).

For suppression of GA oxidase gene(s) using a microRNA (miRNA), the transcribable DNA sequence or suppression element can comprise a DNA sequence derived from a miRNA sequence native to a virus or eukaryote, such as an animal or plant, or modified or derived from such a native miRNA sequence. Such native or native-derived miRNA sequences can form a fold back structure and serve as a scaffold for the precursor miRNA (pre-miRNA), and can correspond to the stem region of a native miRNA precursor sequence, such as from a native (or native-derived) primary-miRNA (pri-miRNA) or pre-miRNA sequence. However, in addition to these native or native-derived miRNA scaffold or preprocessed sequences, engineered or synthetic miRNAs of the present aspects further comprise a sequence corresponding to a segment or portion of the targeted GA oxidase gene(s). Thus, in addition to the pre-processed or scaffold miRNA sequences, the suppression element can further comprise a sense and/or anti-sense sequence that corresponds to a segment or portion of a targeted GA oxidase gene, and/or a sequence that is complementary thereto, although one or more sequence mismatches can be tolerated.

GA oxidase gene(s) can also be suppressed using one or more small interfering RNAs (siRNAs). The siRNA pathway involves the non-phased cleavage of a longer double-stranded RNA intermediate ("RNA duplex") into small interfering RNAs (siRNAs). The size or length of siRNAs ranges from about 19 to about 25 nucleotides or base pairs, but common classes of siRNAs include those containing 21 or 24 base pairs. Thus, a transcribable DNA sequence or suppression element can encode a RNA molecule that is at least about 19 to about 25 nucleotides (or more) in length, such as at least 19, 20, 21, 22, 23, 24, or 25 nucleotides in length. For siRNA suppression, a recombinant DNA molecule, construct or vector can be provided comprising a transcribable DNA sequence and suppression element encoding a siRNA molecule for targeted suppression of a GA oxidase gene(s). A transcribable DNA sequence and suppression element can be at least 19 nucleotides in length and have a sequence corresponding to one or more GA oxidase gene(s), and/or a sequence complementary to one or more GA oxidase gene(s).

GA oxidase gene(s) can also be suppressed using one or more trans-acting small interfering RNAs (ta-siRNAs). In the ta-siRNA pathway, miRNAs serve to guide in-phase processing of siRNA primary transcripts in a process that requires an RNA-dependent RNA polymerase for production of a double-stranded RNA precursor. ta-siRNAs are defined by lack of secondary structure, a miRNA target site that initiates production of double-stranded RNA, requirements of DCL4 and an RNA-dependent RNA polymerase (RDR6), and production of multiple perfectly phased ~21-nt small RNAs with perfectly matched duplexes with 2-nucleotide 3' overhangs (see Allen et al. (2005) *Cell*, 121:207-221). The size or length of ta-siRNAs ranges from about 20 to about 22 nucleotides or base pairs, but are mostly commonly 21 base pairs. A transcribable DNA sequence or suppression element of the present invention can encode a RNA molecule that is at least about 20 to about 22 nucleotides in length, such as 20, 21, or 22 nucleotides in length. For ta-siRNA suppression, a recombinant DNA molecule, construct or vector is thus provided comprising a transcribable DNA sequence or suppression element encoding a ta-siRNA molecule for targeted suppression of a GA oxidase gene(s). Such a transcribable DNA sequence and suppression element can be at least 20 nucleotides in length and have a sequence corresponding to one or more GA oxidase gene(s) and/or a sequence complementary to one or more GA oxidase gene(s). For methods of constructing suitable ta-siRNA scaffolds, see, e.g., U.S. Pat. No. 9,309,512, which is incorporated herein by reference in its entirety.

According to an aspect of the present disclosure, a seed of the modified corn plant is produced, in which the seed comprises a first expression cassette and DNA sequence encoding a non-coding RNA for suppression of one more GA20 oxidase genes and/or one or more GA3 oxidase genes, or one or more mutated or edited GA20 and/or GA3 oxidase genes, and a second expression cassette and DNA sequence encoding one or more CO or COL polypeptides. In an aspect, a progeny plant grown from the seed is semi-dwarf and has one or more improved ear traits, relative to a control corn plant that does not have the suppression element, mutation or edit and the CO/COL transgene. In another aspect, a commodity or commodity product is produced from the seed of the modified corn plant comprising the first transcribable DNA sequence encoding a non-coding RNA for suppression of one more GA20 oxidase genes and/or one or more GA3 oxidase genes, or one or more mutated or edited GA20 and/or GA3 oxidase genes, and the second DNA sequence encoding one or more CO or COL polypeptides.

A transgenic plant can be produced by any suitable transformation method as provided herein to produce a transgenic $R_0$ plant, which can then be selfed or crossed to other plants to generate $R_1$ seed and subsequent progeny generations and seed through additional crosses, etc. Aspects of the present disclosure further include a plant cell, tissue, explant, plant part, etc., comprising one or more transgenic cells having a transformation event or genomic insertion of a recombinant DNA or polynucleotide sequence comprising a transcribable DNA sequence encoding a non-coding RNA molecule that targets an endogenous GA3 or GA20 oxidase gene for suppression and a transgene encoding a CO or COL polypeptide Transgenic plants, plant cells, seeds, and plant parts of the present disclosure can be homozygous or hemizygous for a transgenic event or insertion in at least one plant cell thereof, or a targeted genome editing event or mutation, and plants, plant cells, seeds, and plant parts of the present disclosure can contain any number of copies of such transgenic event(s), insertion(s) mutation(s), and/or edit(s). The dosage or amount of expression of a transgene or transcribable DNA sequence can be altered by its zygosity and/or number of copies, which can affect the degree or extent of phenotypic changes in the transgenic plant, etc.

Transgenic plants provided herein can include a variety of monocot cereal plants, including crop plants, such as corn, wheat, rice and sorghum. Indeed, recombinant DNA molecules or constructs of the present disclosure can be used to create beneficial traits in cereal plants such as corn without off-types using only a single copy of the transgenic event, insertion or construct.

Aspects of the present disclosure further include methods for making or producing transgenic plants, such as by transformation, crossing, etc., wherein the method comprises introducing a recombinant DNA molecule, construct or sequence into a plant cell, and then regenerating or developing the transgenic plant from the transformed or edited plant cell, which can be performed under selection pressure favoring a transgenic event.

Provided in the present disclosure is a method for producing a modified corn plant, the method comprising: introducing into a corn cell a first recombinant expression cassette comprising a DNA sequence encoding a CO or COL polypeptide, wherein the corn cell comprises a second recombinant expression cassette comprising a transcribable DNA sequence encoding a non-coding RNA for suppression of one or more GA3 oxidase genes and/or one or more GA20 oxidase genes; and regenerating or developing a modified corn plant from the corn cell, wherein the modified corn plant comprises the first and second recombinant expression cassettes.

Also provided in the present disclosure is a method for producing a transgenic corn plant, the method comprising: (a) introducing into a first corn cell a transgene that encodes one or more CO or COL polypeptides to create a transgenic corn cell, wherein the first corn cell comprises a transcribable DNA sequence encoding a non-coding RNA for suppression of one or more GA3 oxidase genes or GA20 oxidase genes; and (b) generating a transgenic corn plant from the transgenic corn cell. In an aspect, the method further comprises identifying a transgenic corn plant with a desired trait. In another aspect, the identified transgenic corn plant is semi-dwarf and has one or more improved ear traits, relative to a control corn plant not having both the transgene and the DNA sequence.

Also provided in the present disclosure is a method for producing a modified corn plant, the method comprising: introducing into a corn cell a first recombinant expression cassette comprising a transcribable DNA sequence encoding a non-coding RNA for suppression of one or more GA3 oxidase genes and/or GA20 oxidase genes, wherein the corn cell comprises a second recombinant expression cassette comprising a DNA sequence encoding a CO and/or COL polypeptide; and regenerating or developing a modified corn plant from the corn cell, wherein the modified corn plant comprises the first and second recombinant expression cassettes.

Also provided in the present disclosure is a method for producing a transgenic corn plant, the method comprising: (a) introducing into a first corn cell a transcribable DNA sequence encoding a non-coding RNA for suppression of one or more GA3 oxidase genes or GA20 oxidase genes to create a transgenic corn cell, wherein the first corn cell comprises a transgene that encodes one or more CO or COL polypeptides; and (b) generating a transgenic corn plant from the transgenic corn cell. In an aspect, the method further comprises identifying a transgenic corn plant with a desired trait. In another aspect, the identified transgenic corn plant is semi-dwarf and has one or more improved ear traits, relative to a control corn plant not having both the transgene and the DNA sequence.

Also provided in the present disclosure is a method for producing a modified corn plant, the method comprising introducing into a corn cell 1) a first recombinant expression cassette comprising a transcribable DNA sequence encoding a non-coding RNA for suppression of one or more GA3 oxidase genes and/or GA20 oxidase genes and 2) a second recombinant expression cassette comprising a DNA sequence encoding a CO or COL polypeptide; and regenerating or developing a modified corn plant from the corn cell, wherein the modified corn plant comprises the first and second recombinant expression cassettes.

Also provided in the present disclosure is a method for producing a transgenic corn plant, the method comprising (a) introducing into a first corn cell 1) a transcribable DNA sequence encoding a non-coding RNA for suppression of one or more GA3 oxidase genes or GA20 oxidase genes and 2) a transgene that encodes one or more CO or COL polypeptides, to create a transgenic corn cell; and (b) generating a transgenic corn plant from the transgenic corn cell. In an aspect, the method further comprises identifying a transgenic corn plant with a desired trait. In another aspect, the identified transgenic corn plant is semi-dwarf and has one or more improved ear traits, relative to a control corn plant not having both the transgene and the DNA sequence.

Also provided in the present disclosure is a method for producing a modified corn plant, the method comprising introducing into a corn cell a first recombinant expression cassette comprising a transcribable DNA sequence encoding a non-coding RNA for suppression of one or more GA3 oxidase genes and/or GA20 oxidase genes; introducing into the corn cell of step (a) a second recombinant expression cassette comprising a DNA sequence encoding a CO or COL polypeptide to create a modified corn cell; and regenerating or developing a modified corn plant from the modified corn cell of step (b), wherein the modified corn plant comprises the first and second recombinant expression cassettes.

Also provided in the present disclosure is a method for producing a modified corn plant, the method comprising introducing into a corn cell a first recombinant expression cassette comprising a DNA sequence encoding a CO or COL polypeptide; introducing into the corn cell of step (a) a second recombinant expression cassette comprising a transcribable DNA sequence encoding a non-coding RNA for suppression of one or more GA3 oxidase genes and/or GA20 oxidase genes to create a modified corn cell; and regenerating or developing a modified corn plant from the modified corn cell of step (b), wherein the modified corn plant comprises the first and second recombinant expression cassettes.

Also provided in the present disclosure is a method for producing a transgenic corn plant, the method comprising (a) introducing into a first corn cell a transcribable DNA sequence encoding a non-coding RNA for suppression of one or more GA3 oxidase genes and/or one or more GA20 oxidase genes to create a transgenic corn cell, wherein the first corn cell is genome edited or mutated and comprises a transgene that encodes one or more CO or COL polypeptides; and (b) generating a transgenic corn plant from the transgenic corn cell. In an aspect, the method further comprises identifying a transgenic corn plant with a desired trait. In another aspect, the identified transgenic corn plant is semi-dwarf and has one or more improved ear traits, relative to a control corn plant not having both the DNA sequence and the transgene.

Also provided in the present disclosure is a method for producing a transgenic corn plant, the method comprising (a) introducing into a first corn cell a DNA sequence that encodes one or more CO or COL polypeptides to create a transgenic corn cell, wherein the first corn cell is genome edited or mutated and has a reduced expression of one or more endogenous GA3 oxidase genes and/or one or more GA20 oxidase genes; and (b) generating a transgenic corn plant from the transgenic corn cell. In an aspect, the first corn cell comprises one or more mutation(s) or edit(s) at or near one or more endogenous GA20 oxidase and/or GA3 oxidase gene(s) (e.g., a mutation or edit in two or more endogenous GA20 oxidase and/or GA3 oxidase gene(s), wherein the expression of the endogenous GA20 oxidase and/or GA3 oxidase gene(s) is reduced relative to a wildtype control. In an aspect, the method further comprises identifying a transgenic corn plant with a desired trait. In another aspect, the identified transgenic corn plant is semi-dwarf and has one or more improved ear traits, relative to a control corn plant not having both the DNA sequence and the reduced expression of the one or more endogenous GA3 oxidase and/or GA20 oxidase genes.

Also provided in the present disclosure is a method for producing a modified corn plant, the method comprising: crossing a first modified corn plant with a second modified corn plant, wherein the expression or activity of one or more endogenous GA3 oxidase genes and/or GA20 oxidase genes is reduced in the first modified corn plant relative to a wildtype control, and wherein the second modified corn plant comprises a recombinant expression cassette comprising a DNA sequence encoding a CO or COL polypeptide; and producing a progeny corn plant comprising the recombinant expression cassette and has the reduced expression of the one or more endogenous GA3 oxidase genes and/or GA20 oxidase genes.

Also provided in the present disclosure is a method for producing a transgenic corn plant, the method comprising (a) crossing a first corn plant with a second corn plant to create a modified corn plant, wherein the expression of one or more endogenous GA3 oxidase gene(s) and/or one or more GA20 oxidase gene(s) is reduced in the first corn plant relative to a wildtype control, and wherein the second corn plant comprises a transgene encoding one or more CO or COL polypeptides; and (b) producing an offspring of the transgenic corn plant of step (a). In an aspect, the method further comprises identifying a modified corn plant with a desired trait. In another aspect, the identified modified corn plant is semi-dwarf and has one or more improved ear traits, relative to a control corn plant not having both the transgene and a reduced expression of the one or more endogenous GA3 oxidase and/or GA20 oxidase gene(s).

According to an aspect of the present disclosure, methods are provided for transforming a cell, tissue or explant with a recombinant DNA molecule or construct comprising DNA sequences or transgenes operably linked to one or more promoters to produce a transgenic or genome edited cell. According to other aspects of the present disclosure, methods are provided for transforming a plant cell, tissue or explant with a recombinant DNA molecule or construct comprising transcribable DNA sequences or transgenes operably linked to one or more plant-expressible promoters to produce a transgenic or genome edited plant or plant cell.

Numerous methods for transforming chromosomes or plastids in a plant cell with a recombinant DNA molecule or construct are known in the art, which can be used according to methods of the present disclosure to produce a transgenic plant cell and plant. Any suitable method or technique for transformation of a plant cell known in the art can be used according to present methods.

Effective methods for transformation of plants include bacterially mediated transformation, such as *Agrobacterium*-mediated or *Rhizobium*-mediated transformation and microprojectile particle bombardment-mediated transformation. A variety of methods are known in the art for transforming explants with a transformation vector via bacterially mediated transformation or microprojectile particle bombardment and then subsequently culturing, etc., those explants to regenerate or develop transgenic plants.

In an aspect, the methods for producing a transgenic or modified corn plant disclosed in the present disclosure comprise obtaining the first corn cell and the transgenic corn cell via *Agrobacterium*-mediated transformation.

In another aspect, the methods for producing a transgenic or modified corn plant disclosed in the present disclosure comprise obtaining the first corn cell and the transgenic corn cell via microprojectile particle bombardment-mediated transformation.

In yet another aspect, the methods for producing a transgenic corn plant disclosed in the present disclosure comprises (1) introducing into a first corn cell a transgene via site-directed integration to create a modified or mutated corn cell, wherein the transgene encodes one or more CO or COL polypeptides, and (2) introducing into the modified or mutated corn cell a transcribable DNA sequence via transformation to create a transgenic corn cell, wherein the transcribable DNA sequence encodes a non-coding RNA for suppression of one or more GA3 oxidase genes and/or one or more GA20 oxidase genes. In an aspect, the transformation can be *Agrobacterium*-mediated transformation or microprojectile particle bombardment-mediated transformation.

In still another aspect, the methods for producing a transgenic corn plant disclosed in the present disclosure comprise (1) obtaining a modified corn cell via genome editing, wherein the modified corn cell has a reduced expression of one or more GA3 oxidase genes and/or one or more GA20 oxidase genes; and (2) introducing into the modified corn cell a transgene via transformation to create a transgenic corn cell, wherein the transgene encodes one or more CO or COL polypeptides. In an aspect, the transformation can be *Agrobacterium*-mediated transformation or microprojectile particle bombardment-mediated transformation.

Other methods for plant transformation, such as microinjection, electroporation, vacuum infiltration, pressure, sonication, silicon carbide fiber agitation, PEG-mediated transformation, etc., are also known in the art. Transgenic plants produced by these transformation methods can be chimeric or non-chimeric for the transformation event depending on the methods and explants used.

Methods of transforming plant cells are well known by persons of ordinary skill in the art. For instance, specific instructions for transforming plant cells by microprojectile particle bombardment with particles coated with recombinant DNA are found in U.S. Pat. Nos. 5,550,318; 5,538,880 6,160,208; 6,399,861; and 6,153,812 and *Agrobacterium*-mediated transformation is described in U.S. Pat. Nos. 5,159,135; 5,824,877; 5,591,616; 6,384,301; 5,750,871; 5,463,174; and 5,188,958, all of which are incorporated herein by reference. Additional methods for transforming plants can be found in, for example, Compendium of Transgenic Crop Plants (2009) Blackwell Publishing. Any appropriate method known to those skilled in the art can be used to transform a plant cell with any of the nucleic acid molecules provided herein.

In an aspect, described herein are methods of integrating an insertion sequence encoding one or more CO or COL polypeptides into the genome of a plant cell via site-directed integration. Such methods comprise creating a double-stranded break (DSB) in the genome of the plant cell such that the insertion sequence is integrated at the site of the DSB. In an aspect, the insertion/donor sequence encoding one or more CO or COL polypeptides can be integrated in a targeted manner into the genome of a cell at the location of a DSB. DSBs can be created by any mechanism, including but are not limited to, zinc finger nucleases (ZFN), transcription activator-like effector nuclease (TALEN), meganucleases, recombinases, transposases, and RNA-guided nucleases (e.g., Cas9 and Cpf1) in a CRISPR based genome editing system.

When Cas9 cleaves targeted DNA, endogenous double stranded break (DSB) repair mechanisms are activated. DSBs can be repaired via non-homologous end joining (NHEJ), which can incorporate insertions or deletions (indels) into the targeted locus. If two DSBs flanking one target region are created, the breaks can be repaired by reversing the orientation of the targeted DNA. Alternatively, if an insertion sequence of a donor template with homology to the target DNA sequence is provided, the DSB can be repaired via homology-directed repair or homologous recombination (HR). This repair mechanism allows for the precise integration of an insertion sequence into the targeted DNA sequence.

As used herein, an "insertion sequence" of a donor template is a sequence designed for targeted insertion into the genome of a plant cell, which can be of any suitable length. For example, an insertion sequence can be between 2 and 50,000, between 2 and 10,000, between 2 and 5000, between 2 and 1000, between 2 and 500, between 2 and 250, between 2 and 100, between 2 and 50, between 2 and 30, between 15 and 50, between 15 and 100, between 15 and 500, between 15 and 1000, between 15 and 5000, between 18 and 30, between 18 and 26, between 20 and 26, between 20 and 50, between 20 and 100, between 20 and 250, between 20 and 500, between 20 and 1000, between 20 and 5000, between 20 and 10,000, between 50 and 250, between 50 and 500, between 50 and 1000, between 50 and 5000, between 50 and 10,000, between 100 and 250, between 100 and 500, between 100 and 1000, between 100 and 5000, between 100 and 10,000, between 250 and 500, between 250 and 1000, between 250 and 5000, or between 250 and 10,000 nucleotides or base pairs in length.

According to some aspects, a donor template may not comprise a sequence for insertion into a genome, and instead comprise one or more homology sequences that include(s) one or more mutations, such as an insertion, deletion, substitution, etc., relative to the genomic sequence at a target site within the genome of a plant. Alternatively, a donor template can comprise a sequence that does not comprise a coding or transcribable DNA sequence, wherein the insertion sequence is used to introduce one or more mutations into a target site within the genome of a plant.

A donor template provided herein can comprise at least one, at least two, at least three, at least four, at least five, at least six, at least seven, at least eight, at least nine, or at least ten genes or transcribable DNA sequences. Alternatively, a donor template can comprise no genes. Without being limiting, a gene or transcribable DNA sequence of a donor template can include, for example, an insecticidal resistance gene, an herbicide tolerance gene, a nitrogen use efficiency gene, a water use efficiency gene, a nutritional quality gene, a DNA binding gene, a selectable marker gene, an RNAi or suppression construct, a site-specific genome modification enzyme gene, a single guide RNA of a CRISPR/Cas9 system, a geminivirus-based expression cassette, or a plant viral expression vector system. A donor template can comprise a promoter, such as a tissue-specific or tissue-preferred promoter, a constitutive promoter, or an inducible promoter. A donor template can comprise a leader, enhancer, promoter, transcriptional start site, 5'-UTR, one or more exon(s), one or more intron(s), transcriptional termination site, region or sequence, 3'-UTR, and/or polyadenylation signal. The leader, enhancer, and/or promoter can be operably linked to a gene or transcribable DNA sequence encoding a non-coding RNA, a guide RNA, an mRNA and/or protein.

In an aspect, an insertion sequence of a donor template of the present disclosure comprises a DNA sequence encoding a CO or COL polypeptide, wherein the CO or COL polypeptide is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 176-452 and a functional fragment thereof.

In an aspect, an insertion sequence of a donor template of the present disclosure comprises a DNA sequence encoding a PpCOL polypeptide, wherein the DNA sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

In an aspect, a "modified plant(s)," "modified corn plant(s)," "transgenic plant(s)," or "transgenic corn plant(s)" produced according to a method disclosed in the present disclosure comprises (1) a first transcribable DNA sequence encoding a non-coding RNA for suppression of one or more GA20 oxidase genes and/or one or more GA3 oxidase genes, and (2) a second DNA sequence encoding one or more CO or COL polypeptides.

In another aspect, a "modified plant(s)," "modified corn plant(s)," "transgenic plant(s)," or "transgenic corn plant(s)" produced according to a method disclosed in the present disclosure comprises (1) a DNA sequence encoding one or more CO or COL polypeptides, and (2) a reduced expression of one or more endogenous GA3 oxidase genes or GA20 oxidase genes relative to a wildtype control. In an aspect, the reduced expression of the one or more endogenous GA20 oxidase genes or GA3 oxidase genes is caused by a mutation or edit at or near the one or more endogenous GA20 oxidase genes or GA3 oxidase genes.

Transgenic or modified plants produced by transformation methods can be chimeric or non-chimeric for the transformation event depending on the methods and explants used. Methods are further provided for expressing a non-coding RNA molecule that targets an endogenous GA oxidase gene for suppression in one or more plant cells or tissues under the control of a plant-expressible promoter, such as a constitutive, tissue-specific, tissue-preferred, vascular and/or leaf promoter as provided herein. Such methods can be used to create transgenic cereal or corn plants having a shorter, semi-dwarf stature, reduced internode length, increased stalk/stem diameter, and/or improved lodging resistance. Such transgenic cereal or corn plants can further have other traits that can be beneficial for yield, such as reduced green snap, deeper roots, increased leaf area, earlier canopy closure, improved drought tolerance, increased nitrogen use efficiency, increased water use efficiency, higher stomatal conductance, lower ear height, increased foliar water content, reduced anthocyanin content and/or area in leaves under normal or nitrogen or water limiting stress conditions, increased ear weight, increased seed or kernel number, increased seed or kernel weight, increased yield, and/or increased harvest index, relative to a wild type or control plant. As used herein, "harvest index" refers to the mass of the harvested grain divided by the total mass of the above-ground biomass of the plant over a harvested area.

Alternatively, nucleotide sequences of the disclosure can be introduced into an organism and allowed to undergo recombination with homologous regions of the organism's genome. Such homologous recombination approaches are well known to those of ordinary skill in the art and can be used to stably incorporate sequences of the disclosure into an organism. In an aspect, nucleotide sequences of the disclosure can be used to introduce "knockout mutations" into a specific gene of an organism that shares substantial homology to the sequences of the disclosure. A knockout mutation is any mutation in the sequence of a gene that eliminates or substantially reduces the function or the level of the product encoded by the gene. Methods involving transformation of an organism followed by homologous recombination to stably integrate the sequences of the disclosure into the genome organism are encompassed by the disclosure. The disclosure is particularly directed to methods where sequences of the disclosure are utilized to alter the growth of an organism. Such methods encompass use of the sequences of the disclosure to interfere with the function of one or more GA20 oxidase genes or GA3 oxidase genes. In an aspect, a knockout mutation of one or more GA20 oxidase or GA3 oxidase genes can be introduced into a corn cell via recombination to reduce the expression of the one or more of GA20 oxidase or GA3 oxidase genes in the corn cell.

Cells that have been transformed can be grown into plants in accordance with conventional ways. See, for example, McCormick et al. (1986) *Plant Cell Reports* 5:81-84. These plants can then be grown, and either pollinated with the same transformed strain or different strains, and the resulting hybrid having constitutive expression of the desired phenotypic characteristic identified. Two or more generations can be grown to ensure that constitutive expression of the desired phenotypic characteristic is stably maintained and inherited and then seeds harvested to ensure constitutive expression of the desired phenotypic characteristic has been achieved.

In an aspect, the methods for producing a transgenic or modified corn plant further comprises culturing the transgenic corn plant of step (b) or a plant part thereof in the presence of a selection agent. In another aspect, the selection agent is kanamycin.

Recipient cell or explant targets for transformation include, but are not limited to, a seed cell, a fruit cell, a leaf cell, a cotyledon cell, a hypocotyl cell, a meristem cell, an embryo cell, an endosperm cell, a root cell, a shoot cell, a stem cell, a pod cell, a flower cell, an inflorescence cell, a stalk cell, a pedicel cell, a style cell, a stigma cell, a receptacle cell, a petal cell, a sepal cell, a pollen cell, an anther cell, a filament cell, an ovary cell, an ovule cell, a pericarp cell, a phloem cell, a bud cell, or a vascular tissue cell. In another aspect, this disclosure provides a plant chloroplast. In a further aspect, this disclosure provides an epidermal cell, a stomata cell, a trichome cell, a root hair cell, a storage root cell, or a tuber cell. In another aspect, this disclosure provides a protoplast. In another aspect, this disclosure provides a plant callus cell.

Transformation of a target plant material or explant can be practiced in tissue culture on nutrient media, for example a mixture of nutrients that allow cells to grow in vitro or cell culture. Transformed explants, cells or tissues can be subjected to additional culturing steps, such as callus induction, selection, regeneration, etc., as known in the art. Transformation can also be carried out without creation or use of a callus tissue. Transformed cells, tissues or explants containing a recombinant DNA sequence insertion or event can be grown, developed or regenerated into transgenic plants in culture, plugs, or soil according to methods known in the art. Transgenic plants can be further crossed to themselves or other plants to produce transgenic seeds and progeny. A transgenic plant can also be prepared by crossing a first plant comprising the recombinant DNA sequence or transformation event with a second plant lacking the insertion. For example, a recombinant DNA construct or sequence can be introduced into a first plant line that is amenable to transformation, which can then be crossed with a second plant line to introgress the recombinant DNA construct or sequence into the second plant line. Progeny of these crosses can be further back crossed into the more desirable line multiple times, such as through 6 to 8 generations or back crosses, to produce a progeny plant with substantially the same genotype as the original parental line, but for the introduction of the recombinant DNA construct or sequence.

Any cell from which a fertile plant can be regenerated is contemplated as a useful recipient cell for practice of this disclosure. Callus can be initiated from various tissue sources, including, but not limited to, immature embryos or parts of embryos, seedling apical meristems, microspores, and the like. Those cells which are capable of proliferating as callus can serve as recipient cells for transformation. Practical transformation methods and materials for making transgenic plants of this disclosure (e.g., various media and recipient target cells, transformation of immature embryos, and subsequent regeneration of fertile transgenic plants) are disclosed, for example, in U.S. Pat. Nos. 6,194,636 and 6,232,526 and U. S. Patent Application Publication 2004/0216189, all of which are incorporated herein by reference.

Transformed explants, cells or tissues can be subjected to additional culturing steps, such as callus induction, selection, regeneration, etc., as known in the art. Transformed cells, tissues or explants containing a recombinant DNA insertion can be grown, developed or regenerated into transgenic plants in culture, plugs or soil according to methods known in the art. In an aspect, this disclosure provides plant cells that are not reproductive material and do not mediate the natural reproduction of the plant. In another aspect, this disclosure also provides plant cells that are reproductive material and mediate the natural reproduction of the plant. In another aspect, this disclosure provides plant cells that cannot maintain themselves via photosynthesis. In another aspect, this disclosure provides somatic plant cells. Somatic cells, contrary to germline cells, do not mediate plant reproduction.

Transgenic plants can be further crossed to themselves or other plants to produce transgenic seeds and progeny. A transgenic plant can also be prepared by crossing a first plant comprising the recombinant DNA sequence or transformation event with a second plant lacking the insertion. For example, a recombinant DNA construct or sequence can be introduced into a first plant line that is amenable to transformation, which can then be crossed with a second plant line to introgress the recombinant DNA construct or sequence into the second plant line. Progeny of these crosses can be further back crossed into the more desirable line multiple times, such as through 6 to 8 generations or back crosses, to produce a progeny plant with substantially the same genotype as the original parental line but for the introduction of the recombinant DNA construct or sequence.

A plant, cell, or explant provided herein can be of an elite variety or an elite line. An elite variety or an elite line refers to any variety that has resulted from breeding and selection for superior agronomic performance. A plant, cell, or explant provided herein can be a hybrid plant, cell, or explant. As used herein, a "hybrid" is created by crossing two plants from different varieties, lines, or species, such that the progeny comprises genetic material from each parent. Skilled artisans recognize that higher order hybrids can be generated as well. For example, a first hybrid can be made by crossing Variety C with Variety D to create a C×D hybrid, and a second hybrid can be made by crossing Variety E with Variety F to create an E×F hybrid. The first and second hybrids can be further crossed to create the higher order hybrid (C×D)×(E×F) comprising genetic information from all four parent varieties.

For *Agrobacterium*-mediated transformation, the transformation vector can comprise an engineered transfer DNA (or T-DNA) segment or region having two border sequences, a left border (LB) and a right border (RB), flanking at least a transcribable DNA sequence or transgene, such that insertion of the T-DNA into the plant genome will create a transformation event for the transcribable DNA sequence, transgene or expression cassette. In other words, the transgene, a transcribable DNA sequence, transgene or expression cassette encoding the site-specific nuclease(s), and/or sgRNA(s) or crRNA(s) would be located between the left and right borders of the T-DNA, perhaps along with an additional transgene(s) or expression cassette(s), such as a plant selectable marker transgene and/or other gene(s) of agronomic interest that can confer a trait or phenotype of agronomic interest to a plant.

A plant selectable marker transgene in a transformation vector or construct of the present disclosure can be used to assist in the selection of transformed cells or tissue due to the presence of a selection agent, such as an antibiotic or herbicide, wherein the plant selectable marker transgene provides tolerance or resistance to the selection agent. Thus, the selection agent can bias or favor the survival, development, growth, proliferation, etc., of transformed cells expressing the plant selectable marker gene, such as to increase the proportion of transformed cells or tissues in the $R_0$ plant.

A plant selectable marker transgene in a transformation vector or construct of the present disclosure can be used to assist in the selection of transformed cells or tissue due to the presence of a selection agent, such as an antibiotic or herbicide, wherein the plant selectable marker transgene provides tolerance or resistance to the selection agent. Thus, the selection agent can bias or favor the survival, development, growth, proliferation, etc., of transformed cells expressing the plant selectable marker gene, such as to increase the proportion of transformed cells or tissues in the $R_0$ plant. Commonly used plant selectable marker genes include, for example, those conferring tolerance or resistance to antibiotics, such as kanamycin and paromomycin (nptII), hygromycin B (aph IV), streptomycin or spectinomycin (aadA) and gentamycin (aac3 and aacC4), or those conferring tolerance or resistance to herbicides such as glufosinate (bar orpat), dicamba (DMO) and glyphosate (aroA or EPSPS). Plant screenable marker genes can also be used, which provide an ability to visually screen for transformants, such as luciferase or green fluorescent protein (GFP), or a gene expressing a beta glucuronidase or uidA gene (GUS) for which various chromogenic substrates are known. In some aspects, a vector or polynucleotide provided herein comprises at least one selectable marker gene selected from the group consisting of nptII, aph IV, aadA, aac3, aacC4, bar, pat, DMO, EPSPS, aroA, GFP, and GUS. Plant transformation can also be carried out in the absence of selection during one or more steps or stages of culturing, developing or regenerating transformed explants, tissues, plants and/or plant parts.

An aspect of the present disclosure relate to screening cells, tissues or plants for mutations, targeted edits or transgenes and selecting cells or plants comprising targeted edits or transgenes. Nucleic acids can be isolated using techniques routine in the art. For example, nucleic acids can be isolated using any method including, without limitation, recombinant nucleic acid technology, and/or the polymerase chain reaction (PCR). General PCR techniques are described, for example in PCR Primer: A Laboratory Manual, Dieffenbach & Dveksler, Eds., Cold Spring Harbor Laboratory Press, 1995. Recombinant nucleic acid techniques include, for example, restriction enzyme digestion and ligation, which can be used to isolate a nucleic acid. Isolated nucleic acids also can be chemically synthesized, either as a single nucleic acid molecule or as a series of oligonucleotides. Polypeptides can be purified from natural sources (e.g., a biological sample) by known methods such as DEAE ion exchange, gel filtration, and hydroxyapatite chromatography. A polypeptide also can be purified, for example, by expressing a nucleic acid in an expression vector. In addition, a purified polypeptide can be obtained by chemical synthesis. The extent of purity of a polypeptide can be measured using any appropriate method, e.g., column chromatography, polyacrylamide gel electrophoresis, or HPLC analysis.

In an aspect, this disclosure provides methods of detecting recombinant nucleic acids and polypeptides in plant cells. Without being limiting, nucleic acids also can be detected using hybridization. Hybridization between nucleic acids is discussed in detail in Sambrook et al. (1989, Molecular Cloning: A Laboratory Manual, 2nd Ed., Cold Spring Harbor Laboratory Press, Cold Spring Harbor, N.Y.).

Polypeptides can be detected using antibodies. Techniques for detecting polypeptides using antibodies include enzyme linked immunosorbent assays (ELISAs), Western blots, immunoprecipitations and immunofluorescence. An antibody provided herein can be a polyclonal antibody or a monoclonal antibody. An antibody having specific binding affinity for a polypeptide provided herein can be generated using methods well known in the art. An antibody provided herein can be attached to a solid support such as a microtiter plate using methods known in the art.

Detection (e.g., of an amplification product, of a hybridization complex, of a polypeptide) can be accomplished using detectable labels. The term "label" is intended to encompass the use of direct labels as well as indirect labels. Detectable labels include enzymes, prosthetic groups, fluorescent materials, luminescent materials, bioluminescent materials, and radioactive materials.

The screening and selection of modified or transgenic plants or plant cells can be through any methodologies known to those having ordinary skill in the art. Examples of screening and selection methodologies include, but are not limited to, Southern analysis, PCR amplification for detection of a polynucleotide, Northern blots, RNase protection, primer-extension, RT-PCR amplification for detecting RNA transcripts, Sanger sequencing, Next Generation sequencing technologies (e.g., Illumina, PacBio, Ion Torrent, 454) enzymatic assays for detecting enzyme or ribozyme activity of polypeptides and polynucleotides, marker genotyping, and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

Modified corn plants of the present disclosure having a reduced plant height and improved ear traits relative to a wild-type or control plant can comprise a mutation (e.g., an insertion, deletion, substitution, etc.) introduced through other plant mutagenesis technique or genome editing, wherein expression of one or more GA20 or GA3 oxidase gene is reduced or eliminated in one or more tissues of the modified plant. Modified corn plants of the present disclosure having a reduced plant height and improved ear traits relative to a wild-type or control plant can comprise a transgene encoding one or more CO or COL polypeptides. The transgene can be introduced through other plant mutagenesis technique or genome editing.

Plant mutagenesis techniques (excluding genome editing) can include chemical mutagenesis (i.e., treatment with a chemical mutagen, such as an azide, hydroxylamine, nitrous acid, acridine, nucleotide base analog, or alkylating agent—e.g., EMS (ethylmethane sulfonate), MNU (N-methyl-N-nitrosourea), etc.), physical mutagenesis (e.g., gamma rays, X-rays, UV, ion beam, other forms of radiation, etc.), and insertional mutagenesis (e.g., transposon or T-DNA insertion). Plants or various plant parts, plant tissues or plant cells can be subjected to mutagenesis. Treated plants can be reproduced to collect seeds or produce a progeny plant, and treated plant parts, plant tissues or plant cells can be developed or regenerated into plants or other plant tissues. Mutations generated with chemical or physical mutagenesis techniques can include a frameshift, missense or nonsense mutation leading to loss of function or expression of a targeted gene, such as a GA3 or GA20 oxidase gene.

One method for mutagenesis of a gene is called "TILLING" (for targeting induced local lesions in genomes), in which mutations are created in a plant cell or tissue, preferably in the seed, reproductive tissue or germline of a plant, for example, using a mutagen, such as an EMS treatment. The resulting plants are grown and self-fertilized, and the progeny are used to prepare DNA samples. PCR amplification and sequencing of a nucleic acid sequence of a GA20 or GA3 oxidase gene can be used to identify whether a mutated plant has a mutation in the GA oxidase gene. Plants having mutations in the GA20 or GA3 oxidase gene can then be tested for an altered trait, such as reduced plant height. Alternatively, mutagenized plants can be tested for an altered trait, such as reduced plant height, and then PCR amplification and sequencing of a nucleic acid sequence of a GA20 or GA3 oxidase gene can be used to determine whether a plant having the altered trait also has a mutation in the GA oxidase gene. See, e.g., Colbert et al., 2001, *Plant Physiol* 126:480-484; and McCallum et al., 2000, *Nat. Biotechnol.*, 18:455-457. TILLING can be used to identify mutations that alter the expression a gene or the activity of proteins encoded by a gene, which can be used to introduce and select for a targeted mutation in a GA20 or GA3 oxidase gene of a corn or cereal plant.

Provided in the present disclosure is a recombinant DNA construct comprising 1) a first expression cassette comprising a transcribable DNA sequence encoding a non-coding RNA for suppression of one or more GA20 oxidase or one or more GA3 oxidase genes, and 2) a second expression cassette comprising a DNA sequence encoding a CO or COL polypeptide, wherein the DNA sequence is operably linked to a plant-expressible promoter. In an aspect, the first and second expression cassettes are in a single T-DNA segment of a transformation vector. In another aspect, the first and second expression cassettes are in two different T-DNA segments of a transformation vector.

In an aspect, the transcribable DNA sequence encodes a non-coding RNA for suppression of a GA3 oxidase_1 gene, a GA3 oxidase_2 gene, or both. In another aspect, the transcribable DNA sequence comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37. In another aspect, the transcribable DNA sequence encodes a non-coding RNA comprising a sequence that is 80% complementary to at least 15 consecutive nucleotides of one or more of SEQ ID NOs: 28, 29, 31, 32, 36, and 37.

In another aspect, the transcribable DNA sequence encodes a non-coding RNA for suppression of a GA20 oxidase_3 gene, a GA20 oxidase_4 gene, a GA20 oxidase_5 gene, or a combination thereof. In another aspect, the transcribable DNA sequence comprises a sequence that is at least 80% complementary to at least 15 consecutive nucleotides of SEQ ID NO: 39, 53, or 55. In another aspect, the transcribable DNA sequence encodes a sequence that is at least 80% complementary to at least 15 consecutive nucleotides of SEQ ID NO: 40, 54, or 56.

In another aspect, the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 9, 12, 15, 30, or 33.

In another aspect, the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, 14, 28, 29, 31, or 32.

In an aspect, the DNA sequence comprised in the second expression cassette comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397. In another aspect, the DNA sequence comprised in the second expression cassette comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

In an aspect, the DNA sequence comprised in the second expression cassette encodes a *Physcomitrella patens* CONSTANS-like 1 (PpCOL1) polypeptide. In another aspect, the CO or COL polypeptide comprises an amino acid sequence that is at least 60% identical to SEQ ID NO: 168, or a functional fragment thereof. In another aspect, the DNA sequence comprises a sequence that is at least 60% identical to SEQ ID NO: 169.

Also provided herein is a recombinant DNA construct comprising 1) a first transcribable DNA sequence encoding a non-coding RNA for suppression of one or more GA20 oxidase or one or more GA3 oxidase genes, and 2) a second DNA sequence encoding one or more CO or COL polypeptides.

In an aspect, a recombinant DNA construct of the present disclosure comprises a transcribable DNA sequence encoding a non-coding RNA for suppression of one or more GA20 oxidase or one or more GA3 oxidase genes, wherein the DNA sequence is operably linked to a plant-expressible promoter. Such a recombinant DNA construct can be used to transform a corn plant cell expressing a transgene encoding one or more CO or COL polypeptides to create a transgenic corn plant with desired traits. In another aspect, desired traits comprise semi-dwarf and improved ear traits as compared to a control corn plant not having the transgene and the DNA sequence.

In an aspect, a recombinant DNA construct of the present disclosure comprises a DNA sequence encoding one or more CO or COL polypeptides, wherein the DNA sequence is operably linked to a plant-expressible promoter. Such a recombinant DNA construct can be used to transform a corn plant cell having a reduced expression of one or more GA20 oxidase genes and/or one or more GA3 oxidase genes to create a transgenic corn plant with desired traits. In another aspect, desired traits comprise semi-dwarf and improved ear traits as compared to a control corn plant not having the DNA sequence and the reduced expression of the one or more GA20 oxidase genes and/or GA3 oxidase genes.

Also provided in the present disclosure is a transgenic corn plants comprising the recombinant DNA construct. In an aspect, the first and second DNA sequences are in a single T-DNA molecule. In another aspect, the first and second DNA sequences are in two different T-DNA molecules. In an aspect, the first transcribable DNA sequence is operably linked to a plant-expressible promoter.

In an aspect, a recombinant DNA construct of the present disclosure comprises a transcribable DNA sequence encoding a non-coding RNA molecule, wherein the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 9, 12, 15, 30 or 33, and wherein the transcribable DNA sequence is operably linked to a plant-expressible promoter. In another aspect, the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, 14, 28, 29, 31 or 32.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA20 oxidase protein, the endogenous GA20 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 15. In yet another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 13 or SEQ ID NO: 14.

In another aspect, the non-coding RNA molecule comprises a sequence that is (i) at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA20 oxidase protein, the endogenous GA20 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 9; and/or (ii) at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA20 oxidase protein, the endogenous GA20 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 15.

In another aspect, the non-coding RNA molecule comprises a sequence that is (i) at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7 or 8; and/or (ii) at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 13 or 14.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA20 oxidase protein, the endogenous GA20 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 12.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 10 or 11.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA3 oxidase protein, the endogenous GA3 oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 30 or 33.

In another aspect, the non-coding RNA comprises a sequence that is at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 28, 29, 31 or 32.

In an aspect, the non-coding RNA comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein, the endogenous GA oxidase protein being at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 3, 6, 9, 12, 15, 18, 21, 24, 27, 30 and 33.

In another aspect, the non-coding RNA molecule comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 1, 2, 4, 5, 7, 8, 10, 11, 13, 14, 16, 17, 19, 20, 22, 23, 25, 26, 28, 29, 31, and 32.

In an aspect, a recombinant DNA molecule, vector or construct is provided for suppression of an endogenous GA oxidase (or GA oxidase-like) gene in a corn or cereal plant, the recombinant DNA molecule, vector or construct comprising a transcribable DNA sequence encoding a non-coding RNA molecule, wherein the non-coding RNA molecule comprises a sequence that is (i) at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of any one or more of SEQ ID NO: 84, 85, 87, 88, 89, 91, 92, 93, 95, 96, 98, 99, 100, 102, 103, 105, 106, 107, 109, 110, 111, 113, 114, 115, 117, 119, 120, 122, 123, 124, 126, 127, 128, 130, 131, 132, 134, 135, and/or 137, and/or (ii) at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding a protein in the cereal plant that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to any one or more of SEQ ID NO: 86, 90, 94, 97, 101, 104, 108, 112, 116, 118, 121, 125, 129, 133, and/or 136. Likewise, a non-coding RNA molecule can target an endogenous GA oxidase (or GA oxidase-like) gene in a cereal plant having a percent identity to the GA oxidase gene(s) shown to affect plant height in corn. Thus, a non-coding RNA molecule is further provided comprising a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous protein in a cereal plant that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to any one or more of SEQ ID NO: 9, 12, 15, 30, and/or 33. As mentioned above, the non-coding RNA molecule can target an exon, intron and/or UTR sequence of a GA oxidase (or GA oxidase-like) gene.

A recombinant DNA construct of the present disclosure can comprise or be included within a DNA transformation vector for use in transformation of a target plant cell, tissue or explant. Such a transformation vector of the present disclosure can generally comprise sequences or elements necessary or beneficial for effective transformation in addition to at least one selectable marker gene, at least one expression cassette and/or transcribable DNA sequence encoding one or more site-specific nucleases, and, optionally, one or more sgRNAs or crRNAs.

According to an aspect of the present disclosure, suitable tissue-specific or tissue preferred promoters can include those promoters that drive or cause expression of its associated suppression element or sequence at least in the vascular and/or leaf tissue(s) of a corn or cereal plant, or possibly other tissues.

Expression of the GA oxidase suppression element or construct with a tissue-specific or tissue-preferred promoter can also occur in other tissues of the cereal or corn plant outside of the vascular and leaf tissues, but active GA levels in the developing reproductive tissues of the plant (particularly in the female reproductive organ or ear) are preferably not significantly reduced or impacted (relative to wild type or control plants), such that development of the female organ or ear can proceed normally in the transgenic plant without off-types in the ear and a loss in yield potential.

According to some aspects, constructs and transgenes are provided comprising the first transcribable DNA sequence and the second DNA sequence that are operably linked to a constitutive or tissue-specific or tissue-preferred promoter, such as a vascular or leaf promoter.

In an aspect, the plant-expressible promoter is a vascular promoter. Any vascular promoters known in the art can potentially be used as the tissue-specific or tissue-preferred promoter. Examples of vascular promoters include the RTBV promoter, a known sucrose synthase gene promoter, such as a corn sucrose synthase-1 (Sus1 or Sh1) promoter, a corn Sh1 gene paralog promoter, a barley sucrose synthase promoter (Ss1) promoter, a rice sucrose synthase-1 (RSs1) promoter, or a rice sucrose synthase-2 (RSs2) promoter, a known sucrose transporter gene promoter, such as a rice sucrose transporter promoter (SUT1), or various known viral promoters, such as a *Commelina* yellow mottle virus (CoYMV) promoter, a wheat dwarf geminivirus (WDV) large intergenic region (LIR) promoter, a maize streak geminivirus (MSV) coat protein (CP) promoter, or a rice yellow stripe 1 (YS1)-like or OsYSL2 promoter, and any functional sequence portion or truncation of any of the foregoing promoters with a similar pattern of expression, such as a truncated RTBV promoter.

In another aspect, the vascular promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 67, SEQ ID NO: 68, SEQ ID NO: 69, SEQ ID NO: 70, or SEQ ID NO: 71, or a functional portion thereof.

In another aspect, the plant-expressible promoter is a rice tungro bacilliform virus (RTBV) promoter. In an aspect, the RTBV promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 65 or SEQ ID NO: 66, or a functional portion thereof.

In another aspect, the plant-expressible promoter is a leaf promoter. Any leaf promoters known in the art can potentially be used as the tissue-specific or tissue-preferred promoter. Examples of leaf promoters include a corn pyruvate phosphate dikinase or PPDK promoter, a corn fructose 1,6 bisphosphate aldolase or FDA promoter, and a rice Nadh-Gogat promoter, and any functional sequence portion or truncation of any of the foregoing promoters with a similar pattern of expression. Other examples of leaf promoters from monocot plant genes include a ribulose biphosphate carboxylase (RuBisCO) or RuBisCO small subunit (RBCS) promoter, a chlorophyll a/b binding protein gene promoter, a phosphoenolpyruvate carboxylase (PEPC) promoter, and a Myb gene promoter, and any functional sequence portion or truncation of any of these promoters with a similar pattern of expression.

In another aspect, the leaf promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NO: 72, SEQ ID NO: 73 or SEQ ID NO: 74, or a functional portion thereof.

In another aspect, the plant-expressible promoter is a constitutive promoter. Examples of constitutive promoters that can be used in monocot plants, such as cereal or corn plants, include, for example, various actin gene promoters, such as a rice Actin 1 promoter (see, e.g., U.S. Pat. No. 5,641,876) and a rice Actin 2 promoter (see, e.g., U.S. Pat. No. 6,429,357), a CaMV 35S or 19S promoter (see, e.g., U.S. Pat. No. 5,352,605), a maize ubiquitin promoter (see, e.g., U.S. Pat. No. 5,510,474), a *Coix lacryma-jobi* polyubiquitin promoter, a rice or maize Gos2 promoter (see, e.g., Pater et al., *Plant J.*, 2(6): 837-44 1992), a FMV 35S promoter (see, e.g., U.S. Pat. No. 6,372,211), a dual enhanced CMV promoter (see, e.g., U.S. Pat. No. 5,322,938), a MMV promoter (see, e.g., U.S. Pat. No. 6,420,547), a PCLSV promoter (see, e.g., U.S. Pat. No. 5,850,019), an Emu promoter (see, e.g., Last et al., *Theor. Appl. Genet.*, 81:581 (1991); and Mcelroy et al., *Mol. Gen. Genet.*, 231: 150 (1991)), a tubulin promoter from maize, rice or other species, a nopaline synthase (nos) promoter, an octopine synthase (ocs) promoter, a mannopine synthase (mas) promoter, or a plant alcohol dehydrogenase (e.g., maize Adh1) promoter, any other promoters including viral promoters known or later-identified in the art to provide constitutive expression in a cereal or corn plant, any other constitutive promoters known in the art that can be used in monocot or cereal plants, and any functional sequence portion or truncation of any of the foregoing promoters.

In another aspect, the constitutive promoter comprises a DNA sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 75, SEQ ID NO: 76, SEQ ID NO: 77, SEQ ID NO: 78, SEQ ID NO: 79, SEQ ID NO: 80, SEQ ID NO: 81, SEQ ID NO: 82 or SEQ ID NO: 83, or a functional portion thereof.

Tissue-specific and tissue-preferred promoters that drive, etc., a moderate or strong level of expression of their associated transcribable DNA sequence in active GA-producing tissue(s) of a plant can be preferred. Furthermore, such tissue-specific and tissue-preferred should drive, etc., expression of their associated transcribable DNA sequence during one or more vegetative stage(s) of plant development when the plant is growing and/or elongating including one or more of the following vegetative stage(s): $V_E$, V1, V2, V3, V4, V5, V6, V7, V8, V9, V10, V11, V12, V13, V14, Vn, $V_T$, such as expression at least during V3-V12, V4-V12, V5-V12, V6-V12, V7-V12, V8-V12, V3-V14, V5-V14, V6-V14, V7-V14, V8-V14, V9-V14, V10-V14, etc., or during any other range of vegetative stages when growth and/or elongation of the plant is occurring.

According to an aspect, the plant-expressible promoter can preferably drive expression constitutively or in at least a portion of the vascular and/or leaf tissues of the plant. Different promoters driving expression of a suppression element targeting the endogenous GA20 oxidase_3 and/or GA20 oxidase_5 gene(s), the GA20 oxidase_4 gene, the GA3 oxidase_1 and/or GA3 oxidase_2 gene(s) in corn, or similar genes and homologs in other cereal plants, can be effective at reducing plant height and increasing lodging resistance to varying degrees depending on their particular pattern and strength of expression in the plant. However, some tissue-specific and tissue-preferred promoters driving expression of a GA20 or GA3 oxidase suppression element in a plant may not produce a short stature or anti-lodging phenotypes due to the spatial-temporal pattern of expression of the promoter during plant development, and/or the amount or strength of expression of the promoter being too low or weak. Furthermore, some suppression constructs can only reduce and not eliminate expression of the targeted GA20 or GA3 oxidase gene(s) when expressed in a plant, and thus depending on the pattern and strength of expression with a given promoter, the pattern and level of expression of the GA20 or GA3 oxidase suppression construct with such a promoter may not be sufficient to produce an observable plant height and lodging resistance phenotype in plants.

Any other vascular and/or leaf promoters known in the art can also be used, including promoter sequences from related genes (e.g., sucrose synthase, sucrose transporter, and viral gene promoter sequences) from the same or different plant species or virus that have a similar pattern of expression. Further provided are promoter sequences with a high degree of homology to any of the foregoing. Examples of vascular and/or leaf promoters can further include other known, engineered and/or later-identified promoter sequences shown to have a pattern of expression in vascular and/or leaf tissue(s) of a cereal or corn plant. Furthermore, any known or later-identified constitutive promoter can also be used for expression of a GA20 oxidase or GA3 oxidase suppression element.

In addition to its associated promoter, a transcribable DNA sequence or a transgene can also be operatively linked to one or more additional regulatory element(s), such as an enhancer(s), leader, transcription start site (TSS), linker, 5' and 3' untranslated region(s) (UTRs), intron(s), polyadenylation signal, termination region or sequence, etc., that are suitable, necessary or preferred for strengthening, regulating or allowing expression of the transcribable DNA sequence in a plant cell. Such additional regulatory element(s) can be optional and/or used to enhance or optimize expression of the transgene or transcribable DNA sequence. As provided herein, an "enhancer" can be distinguished from a "promoter" in that an enhancer typically lacks a transcription start site, TATA box, or equivalent sequence and is thus insufficient alone to drive transcription. As used herein, a "leader" can be defined generally as the DNA sequence of the 5'-UTR of a gene (or transgene) between the transcription start site (TSS) and 5' end of the transcribable DNA sequence or protein coding sequence start site of the transgene.

In an aspect, the second DNA sequence encoding one or more CO or COL polypeptides comprised in a recombinant DNA construct of the present application is operably linked to a plant-expressible promoter, such as a constitutive or tissue-specific promoter. According to an aspect, the plant-expressible promoter is a medium or high-constitutive promoter with a high-constitutive promoter having a relatively more robust or strong constitutive expression. In an aspect, the plant-expressible promoter is a constitutive promoter, which can be selected from the group consisting of an actin promoter, a Cauliflower mosaic virus (CaMV) 35S or 19S promoter, a plant ubiquitin promoter, a plant Gos2 promoter, a Figwort mosaic virus (FMV) promoter, a cytomegalovirus (CMV) promoter, a Mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

In an aspect, a transformation vector comprising the recombinant DNA construct is produced. In another aspect, a transgenic corn plant or a plant part thereof comprising the recombinant DNA construct is produced. In still another aspect, the transgenic corn plant is semi-dwarf and has one or more improved ear traits, relative to a control corn plant not having both the first transcribable DNA sequence and the second DNA sequence.

A recombinant DNA molecule or construct of the present disclosure can comprise or be included within a DNA transformation vector for use in transformation of a target plant cell, tissue or explant. Such a transformation vector can generally comprise sequences or elements necessary or beneficial for effective transformation in addition to at least one transgene, expression cassette and/or transcribable DNA sequence.

For Agrobacterium-mediated, Rhizobia-mediated or other bacteria-mediated transformation, the transformation vector can comprise an engineered transfer DNA (or T-DNA) segment or region having two border sequences, a left border (LB) and a right border (RB), flanking at least a transcribable DNA sequence or transgene, such that insertion of the T-DNA into the plant genome will create a transformation event for the transcribable DNA sequence, transgene or expression cassette. Thus, a transcribable DNA sequence, transgene or expression cassette can be located between the left and right borders of the T-DNA, perhaps along with an additional transgene(s) or expression cassette(s), such as a plant selectable marker transgene and/or other gene(s) of agronomic interest that can confer a trait or phenotype of agronomic interest to a plant. According to alternative aspects, the transcribable DNA sequence, transgene or expression cassette encoding a non-coding RNA molecule targeting an endogenous GA oxidase gene for suppression and the plant selectable marker transgene (or other gene of agronomic interest) can be present in separate T-DNA segments on the same or different recombinant DNA molecule(s), such as for co-transformation. A transformation vector or construct can further comprise prokaryotic maintenance elements, which can be located in the vector outside of the T-DNA region(s).

The present disclosure provides a modified corn plant with a semi-dwarf phenotype and one or more improved ear traits relative to a control plant. The modified corn plant has its expression of one or more GA20 oxidase genes and/or one or more GA3 oxidase genes reduced and comprises a transgene expressing one or more CO or COL polypeptides. In an aspect, the reduced expression of the one or more GA20 oxidase genes and/or one or more GA3 oxidase genes is caused by a mutation or edit at or near the one or more GA20 oxidase genes and/or GA3 oxidase genes introduced via genome editing. In another aspect, the reduced expression of one or more GA20 oxidase genes and/or one or more GA3 oxidase genes is caused by a site-directed integration of a transcribable DNA sequence encoding a non-coding RNA for suppression of the one or more GA20 oxidase genes and/or one or more GA3 oxidase genes. In an aspect, the site-directed integration is mediated by genome editing. In an aspect, the introduction of the transgene expressing one or more CO or COL polypeptides is caused by a site-directed integration of a sequence comprising the transgene. In another aspect, the site-directed integration is mediated by genome editing.

In an aspect, a genome editing system provided herein comprises a CRISPR system. The CRISPR systems are based on RNA-guided engineered nucleases that use complementary base pairing to recognize DNA sequences at target sites. In an aspect, a vector provided herein can comprise any combination of a nucleic acid sequence encoding a RNA-guided nuclease.

In an aspect, a method and/or composition provided herein comprises one or more, two or more, three or more, four or more, or five or more Cas9 nucleases. In an aspect, a method and/or composition provided herein comprises one or more polynucleotides encoding one or more, two or more, three or more, four or more, or five or more Cas9 nucleases. In another aspect, a Cas9 nuclease provided herein is capable of generating a targeted DSB. In an aspect, a method and/or composition provided herein comprises one or more, two or more, three or more, four or more, or five or more Cpf1 nucleases. In an aspect, a method and/or composition provided herein comprises one or more polynucleotides encoding one or more, two or more, three or more, four or more, or five or more Cpf1 nucleases. In another aspect, a Cpf1 nuclease provided herein is capable of generating a targeted DSB.

In an aspect, a vector or construct provided herein comprises polynucleotides encoding at least 1, at least 2, at least 3, at least 4, at least 5, at least 6, at least 7, at least 8, at least 9, or at least 10 site-specific nuclease. In another aspect, a cell provided herein already comprises a site-specific nuclease. In an aspect, a polynucleotide encoding a site-specific nuclease provided herein is stably transformed into a cell. In another aspect, a polynucleotide encoding a site-specific nuclease provided herein is transiently transformed into a cell. In another aspect, a polynucleotide encoding a site-specific nuclease is under the control of a regulatable promoter, a constitutive promoter, a tissue specific promoter, or any promoter useful for expression of the site-specific nuclease.

In an aspect, vectors comprising polynucleotides encoding a site-specific nuclease, and optionally one or more, two or more, three or more, or four or more sgRNAs are provided to a plant cell by transformation methods known in the art (e.g., without being limiting, particle bombardment, PEG-mediated protoplast transfection or *Agrobacterium*-mediated transformation). In an aspect, vectors comprising polynucleotides encoding a Cas9 nuclease, and optionally one or more, two or more, three or more, or four or more sgRNAs are provided to a plant cell by transformation methods known in the art (e.g., without being limiting, particle bombardment, PEG-mediated protoplast transfection or *Agrobacterium*-mediated transformation). In another aspect, vectors comprising polynucleotides encoding a Cpf1 and, optionally one or more, two or more, three or more, or four or more crRNAs are provided to a cell by transformation methods known in the art (e.g., without being limiting, viral transfection, particle bombardment, PEG-mediated protoplast transfection or *Agrobacterium*-mediated transformation).

In an aspect, a vector comprises in cis a cassette encoding a site-specific nuclease and an insertion sequence such that when contacted with the genome of a cell, the site-specific nuclease enables site-specific integration of the insertion sequence. In an aspect, a first vector comprises a cassette encoding a site-specific nuclease and a second vector comprises an insertion sequence such that when contacted with the genome of a cell, the site-specific nuclease provided in trans enables site-specific integration of the insertion sequence.

Site-specific nucleases provided herein can be used as part of a targeted editing technique. Non-limiting examples of site-specific nucleases used in methods and/or compositions provided herein include meganucleases, zinc finger nucleases (ZFNs), transcription activator-like effector nucleases (TALENs), RNA-guided nucleases (e.g., Cas9 and Cpf1), a recombinase (without being limiting, for example, a serine recombinase attached to a DNA recognition motif, a tyrosine recombinase attached to a DNA recognition motif), a transposase (without being limiting, for example, a DNA transposase attached to a DNA binding domain), or any combination thereof. In an aspect, a method provided herein comprises the use of one or more, two or more, three or more, four or more, or five or more site-specific nucleases to induce one, two, three, four, five, or more than five DSBs at one, two, three, four, five, or more than five target sites.

In an aspect, a genome editing system provided herein (e.g., a meganuclease, a ZFN, a TALEN, a CRISPR/Cas9 system, a CRISPR/Cpf1 system, a recombinase, a transposase), or a combination of genome editing systems provided herein, is used in a method to introduce one or more insertions, deletions, substitutions, or inversions to a locus in a cell to introduce a mutation, or generate a dominant negative allele or a dominant positive allele.

Site-specific nucleases, such as meganucleases, ZFNs, TALENs, Argonaute proteins (non-limiting examples of Argonaute proteins include *Thermus thermophilus* Argonaute (TtAgo), *Pyrococcus furiosus* Argonaute (PfAgo), *Natronobacterium gregoryi* Argonaute (NgAgo), homologs thereof, or modified versions thereof), Cas9 nucleases (non-limiting examples of RNA-guided nucleases include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, homologs thereof, or modified versions thereof), induce a double-strand DNA break at the target site of a genomic sequence that is then repaired by the natural processes of HR or NHEJ. Sequence modifications then occur at the cleaved sites, which can include inversions, deletions, or insertions that result in gene disruption in the case of NHEJ, or integration of nucleic acid sequences by HR.

In an aspect, a site-specific nuclease provided herein is selected from the group consisting of a zinc-finger nuclease, a meganuclease, an RNA-guided nuclease, a TALE-nuclease, a recombinase, a transposase, or any combination thereof. In another aspect, a site-specific nuclease provided herein is selected from the group consisting of a Cas9 or a Cpf1.

In another aspect a site-specific nuclease provided herein is selected from the group consisting of a Cas1, a Cas1B, a Cas2, a Cas3, a Cas4, a Cas5, a Cas6, a Cas7, a Cas8, a Cas9, a Cas10, a Csy1, a Csy2, a Csy3, a Cse1, a Cse2, a Csc1, a Csc2, a Csa5, a Csn2, a Csm2, a Csm3, a Csm4, a Csm5, a Csm6, a Cmr1, a Cmr3, a Cmr4, a Cmr5, a Cmr6, a Csb1, a Csb2, a Csb3, a Csx17, a Csx14, a Csx10, a Csx16, a CsaX, a Csx3, a Csx1, a Csx15, a Csf1, a Csf2, a Csf3, a Csf4, a Cpf1, a homolog thereof, or a modified version thereof. In another aspect, an RNA-guided nuclease provided herein is selected from the group consisting of a Cas9 or a Cpf1.

In another aspect an RNA guided nuclease provided herein is selected from the group consisting of a Cas1, a Cas1B, a Cas2, a Cas3, a Cas4, a Cas5, a Cas6, a Cas7, a Cas8, a Cas9, a Cas10, a Csy1, a Csy2, a Csy3, a Cse1, a Cse2, a Csc1, a Csc2, a Csa5, a Csn2, a Csm2, a Csm3, a Csm4, a Csm5, a Csm6, a Cmr1, a Cmr3, a Cmr4, a Cmr5, a Cmr6, a Csb1, a Csb2, a Csb3, a Csx17, a Csx14, a Csx10, a Csx16, a CsaX, a Csx3, a Csx1, a Csx15, a Csf1, a Csf2, a Csf3, a Csf4, a Cpf1, a homolog thereof, or a modified version thereof.

In another aspect, a method and/or a composition provided herein comprises at least one, at least two, at least three, at least four, at least five, at least six, at least seven, at least eight, at least nine, or at least ten site-specific nucleases. In yet another aspect, a method and/or a composition provided herein comprises at least one, at least two, at least three, at least four, at least five, at least six, at least seven, at least eight, at least nine, or at least ten polynucleotides encoding at least one, at least two, at least three, at least four, at least five, at least six, at least seven, at least eight, at least nine, or at least ten site-specific nucleases.

In an aspect, an RNA-guided nuclease provided herein is selected from the group consisting of Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, homologs thereof, or modified versions thereof, an Argonaute (non-limiting examples of Argonaute proteins include *Thermus thermophilus* Argonaute (TtAgo), *Pyrococcus furiosus* Argonaute (PfAgo), *Natronobacterium gregoryi* Argonaute (NgAgo), homologs thereof, modified versions thereof), a DNA guide for an Argonaute protein, and any combination thereof. In another aspect, an RNA-guided nuclease provided herein is selected from the group consisting of Cas9 and Cpf1.

In another aspect, an RNA-guided nuclease provided herein comprises Cas9. In an aspect, an RNA-guided nuclease provided herein is selected from the group consisting of Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, homologs thereof, or modified versions thereof. In an aspect a site-specific nuclease is selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, TtAgo, PfAgo, and NgAgo. In another aspect, an RNA-guided nuclease is selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, Cpf1, TtAgo, PfAgo, and NgAgo.

A target site can be positioned in a polynucleotide sequence encoding a leader, an enhancer, a transcriptional start site, a promoter, a 5'-UTR, an exon, an intron, a 3'-UTR, a polyadenylation site, or a termination sequence. It will be appreciated that a target site can also be positioned upstream or downstream of a sequence encoding a leader, an enhancer, a transcriptional start site, a promoter, a 5'-UTR, an exon, an intron, a 3'-UTR, a polyadenylation site, or a termination sequence. In an aspect, a target site is positioned within 10, within 20, within 30, within 40, within 50, within 75, within 100, within 125, within 150, within 200, within 250, within 300, within 400, within 500, within 600, within 700, within 800, within 900, within 1000, within 1250, within 1500, within 2000, within 2500, within 5000, within 10,000, or within 25,000 nucleotides of a polynucleotide encoding a leader, an enhancer, a transcriptional start site, a promoter, a 5'-UTR, an exon, an intron, a 3'-UTR, a polyadenylation site, a gene, or a termination sequence.

In an aspect, a target site bound by an RNA-guided nuclease is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of SEQ ID NO: 34, 35, 36, 37, or 38, or a sequence complementary thereto.

In an aspect, a targeted genome editing technique described herein can comprise the use of a recombinase. In an aspect, a tyrosine recombinase attached to a DNA recognition motif is selected from the group consisting of a Cre recombinase, a Gin recombinase a Flp recombinase, and a Tnp1 recombinase. In an aspect, a Cre recombinase or a Gin recombinase provided herein is tethered to a zinc-finger DNA binding domain. The Flp-FRT site-directed recombination system comes from the 2μ plasmid from the baker's yeast Saccharomyces cerevisiae. In this system, Flp recombinase (flippase) recombines sequences between flippase recognition target (FRT) sites. FRT sites comprise 34 nucleotides. Flp binds to the "arms" of the FRT sites (one arm is in reverse orientation) and cleaves the FRT site at either end of an intervening nucleic acid sequence. After cleavage, Flp recombines nucleic acid sequences between two FRT sites. Cre-lox is a site-directed recombination system derived from the bacteriophage P1 that is similar to the Flp-FRT recombination system. Cre-lox can be used to invert a nucleic acid sequence, delete a nucleic acid sequence, or translocate a nucleic acid sequence. In this system, Cre recombinase recombines a pair of lox nucleic acid sequences. Lox sites comprise 34 nucleotides, with the first and last 13 nucleotides (arms) being palindromic. During recombination, Cre recombinase protein binds to two lox sites on different nucleic acids and cleaves at the lox sites. The cleaved nucleic acids are spliced together (reciprocally translocated) and recombination is complete. In another aspect, a lox site provided herein is a loxP, lox 2272, loxN, lox 511, lox 5171, lox71, lox66, M2, M3, M7, or M11 site.

In another aspect, a serine recombinase attached to a DNA recognition motif provided herein is selected from the group consisting of a PhiC31 integrase, an R4 integrase, and a TP-901 integrase. In another aspect, a DNA transposase attached to a DNA binding domain provided herein is selected from the group consisting of a TALE-piggyBac and TALE-Mutator.

Several site-specific nucleases, such as recombinases, zinc finger nucleases (ZFNs), meganucleases, and TALENs, are not RNA-guided and instead rely on their protein structure to determine their target site for causing the DSB or nick, or they are fused, tethered or attached to a DNA-binding protein domain or motif.

ZFNs are synthetic proteins consisting of an engineered zinc finger DNA-binding domain fused to the cleavage domain of the FokI restriction nuclease. ZFNs can be designed to cleave almost any long stretch of double-stranded DNA for modification of the zinc finger DNA-binding domain. ZFNs form dimers from monomers composed of a non-specific DNA cleavage domain of FokI nuclease fused to a zinc finger array engineered to bind a target DNA sequence.

DNA-binding domain of a ZFN is typically composed of 3-4 zinc-finger arrays. The amino acids at positions −1, +2, +3, and +6 relative to the start of the zinc finger ∞-helix, which contribute to site-specific binding to the target DNA, can be changed and customized to fit specific target sequences. The other amino acids form the consensus backbone to generate ZFNs with different sequence specificities. Rules for selecting target sequences for ZFNs are known in the art.

FokI nuclease domain requires dimerization to cleave DNA and therefore two ZFNs with their C-terminal regions are needed to bind opposite DNA strands of the cleavage site (separated by 5-7 bp). The ZFN monomer can cut the target site if the two-ZF-binding sites are palindromic. The term ZFN, as used herein, is broad and includes a monomeric ZFN that can cleave double stranded DNA without assistance from another ZFN. The term ZFN is also used to refer to one or both members of a pair of ZFNs that are engineered to work together to cleave DNA at the same site.

Without being limited by any scientific theory, because the DNA-binding specificities of zinc finger domains can be re-engineered using one of various methods, customized ZFNs can theoretically be constructed to target nearly any target sequence (e.g., at or near a GA oxidase gene in a plant genome). Publicly available methods for engineering zinc finger domains include Context-dependent Assembly (CoDA), Oligomerized Pool Engineering (OPEN), and Modular Assembly. In an aspect, a method and/or composition provided herein comprises one or more, two or more, three or more, four or more, or five or more ZFNs. In another aspect, a ZFN provided herein is capable of generating a targeted DSB or nick. In an aspect, vectors comprising polynucleotides encoding one or more, two or more, three or more, four or more, or five or more ZFNs are provided to a cell by transformation methods known in the art (e.g., without being limiting, viral transfection, particle bombardment, PEG-mediated protoplast transfection, or *Agrobacterium*-mediated transformation). The ZFNs can be introduced as ZFN proteins, as polynucleotides encoding ZFN proteins, and/or as combinations of proteins and protein-encoding polynucleotides.

In an aspect, a method and/or composition provided herein comprises one or more, two or more, three or more, four or more, or five or more ZFNs. In another aspect, a ZFN provided herein is capable of generating a targeted DSB. In an aspect, vectors comprising polynucleotides encoding one or more, two or more, three or more, four or more, or five or more ZFNs are provided to a cell by transformation methods known in the art (e.g., without being limiting, viral transfection, particle bombardment, PEG-mediated protoplast transfection or *Agrobacterium*-mediated transformation).

Meganucleases, which are commonly identified in microbes, such as the LAGLIDADG family of homing endonucleases, are unique enzymes with high activity and long recognition sequences (>14 bp) resulting in site-specific digestion of target DNA. Engineered versions of naturally occurring meganucleases typically have extended DNA recognition sequences (for example, 14 to 40 bp). According to some aspects, a meganuclease can comprise a scaffold or base enzyme selected from the group consisting of I-CreI, I-CeuI, I-MsoI, I-SceI, I-AniI, and I-DmoI. The engineering of meganucleases can be more challenging than ZFNs and TALENs because the DNA recognition and cleavage functions of meganucleases are intertwined in a single domain. Specialized methods of mutagenesis and high-throughput screening have been used to create novel meganuclease variants that recognize unique sequences and possess improved nuclease activity. Thus, a meganuclease can be selected or engineered to bind to a genomic target sequence in a plant, such as at or near the genomic locus of a GA oxidase gene. In an aspect, a method and/or composition provided herein comprises one or more, two or more, three or more, four or more, or five or more meganucleases. In another aspect, a meganuclease provided herein is capable of generating a targeted DSB. In an aspect, vectors comprising polynucleotides encoding one or more, two or more, three or more, four or more, or five or more meganucleases are provided to a cell by transformation methods known in the art (e.g., without being limiting, viral transfection, particle bombardment, PEG-mediated protoplast transfection or *Agrobacterium*-mediated transformation).

TALENs are artificial restriction enzymes generated by fusing the transcription activator-like effector (TALE) DNA binding domain to a FokI nuclease domain. When each member of a TALEN pair binds to the DNA sites flanking a target site, the FokI monomers dimerize and cause a double-stranded DNA break at the target site. Besides the wild-type FokI cleavage domain, variants of the FokI cleavage domain with mutations have been designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain and the number of bases between the two individual TALEN binding sites are parameters for achieving high levels of activity.

TALENs are artificial restriction enzymes generated by fusing the transcription activator-like effector (TALE) DNA binding domain to a nuclease domain. In some aspects, the nuclease is selected from a group consisting of PvuII, MutH, TevI and FokI, AlwI, MlyI, SbfI, SdaI, StsJ, CleDORF, Clo051, Pept071. When each member of a TALEN pair binds to the DNA sites flanking a target site, the FokI monomers dimerize and cause a double-stranded DNA break at the target site.

The term TALEN, as used herein, is broad and includes a monomeric TALEN that can cleave double stranded DNA without assistance from another TALEN. The term TALEN is also used to refer to one or both members of a pair of TALENs that work together to cleave DNA at the same site.

Transcription activator-like effectors (TALEs) can be engineered to bind practically any DNA sequence. TALE proteins are DNA-binding domains derived from various plant bacterial pathogens of the genus *Xanthomonas*. The X pathogens secrete TALEs into the host plant cell during infection. The TALE moves to the nucleus, where it recognizes and binds to a specific DNA sequence in the promoter region of a specific DNA sequence in the promoter region of a specific gene in the host genome. TALE has a central DNA-binding domain composed of 13-28 repeat monomers of 33-34 amino acids. The amino acids of each monomer are highly conserved, except for hypervariable amino acid residues at positions 12 and 13. The two variable amino acids are called repeat-variable diresidues (RVDs). The amino acid pairs NI, NG, HD, and NN of RVDs preferentially recognize adenine, thymine, cytosine, and guanine/adenine, respectively, and modulation of RVDs can recognize consecutive DNA bases. This simple relationship between amino acid sequence and DNA recognition has allowed for the engineering of specific DNA binding domains by selecting a combination of repeat segments containing the appropriate RVDs.

Besides the wild-type FokI cleavage domain, variants of the FokI cleavage domain with mutations have been designed to improve cleavage specificity and cleavage activity. The FokI domain functions as a dimer, requiring two constructs with unique DNA binding domains for sites in the target genome with proper orientation and spacing. Both the number of amino acid residues between the TALEN DNA binding domain and the FokI cleavage domain and the number of bases between the two individual TALEN binding sites are parameters for achieving high levels of activity. PvuII, MutH, and TevI cleavage domains are useful alternatives to FokI and FokI variants for use with TALEs. PvuII functions as a highly specific cleavage domain when coupled to a TALE (see Yank et al. 2013. *PLoS One*. 8: e82539). MutH is capable of introducing strand-specific nicks in DNA (see Gabsalilow et al. 2013. *Nucleic Acids Research*. 41: e83). TevI introduces double-stranded breaks in DNA at targeted sites (see Beurdeley et al., 2013. *Nature Communications*. 4: 1762).

The relationship between amino acid sequence and DNA recognition of the TALE binding domain allows for designable proteins. Software programs such as DNA Works can be used to design TALE constructs. Other methods of designing TALE constructs are known to those of skill in the art. See Doyle et al., *Nucleic Acids Research* (2012) 40: W117-122; Cermak et al., *Nucleic Acids Research* (2011). 39:e82; and tale-nt.cac.cornell.edu/about.

In an aspect, a method and/or composition provided herein comprises one or more, two or more, three or more, four or more, or five or more TALENs. In another aspect, a TALEN provided herein is capable of generating a targeted DSB. In an aspect, vectors comprising polynucleotides encoding one or more, two or more, three or more, four or more, or five or more TALENs are provided to a cell by transformation methods known in the art (e.g., without being limiting, viral transfection, particle bombardment, PEG-mediated protoplast transfection or *Agrobacterium*-mediated transformation).

As used herein, a "targeted genome editing technique" refers to any method, protocol, or technique that allows the precise and/or targeted editing of a specific location in a genome of a plant (i.e., the editing is largely or completely non-random) using a site-specific nuclease, such as a meganuclease, a zinc-finger nuclease (ZFN), an RNA-guided endonuclease (e.g., the CRISPR/Cas9 system), a TALE-endonuclease (TALEN), a recombinase, or a transposase.

Provided in the present disclosure is a modified corn plant comprising 1) one or more mutations or edits at or near one or more endogenous GA20 oxidase and/or GA3 oxidase genes, wherein the expression or activity of the one or more endogenous GA20 oxidase and/or GA3 oxidase genes is reduced relative to a wildtype control plant, and 2) a recombinant expression cassette comprising a DNA sequence encoding a CO or COL polypeptide, wherein the DNA sequence is operably linked to a plant-expressible promoter. In an aspect, the modified corn plant is semi-dwarf and has one or more improved ear traits, relative to a control corn plant that does not comprise both the one or more mutations or edits and the recombinant expression cassette. In another aspect, the one or more mutations or edits are selected from the group consisting of an insertion, a substitution, an inversion, a deletion, a duplication, and a combination thereof. In yet another aspect, the one or more mutations or edits are introduced using a meganuclease, a zinc-finger nuclease (ZFN), a RNA-guided endonuclease, a TALE-endonuclease (TALEN), a recombinase, or a transposase.

Also provided is a plurality of modified corn plants in a field, each modified corn plant comprising one or more mutations or edits at or near one or more endogenous GA20 oxidase and/or GA3 oxidase genes, wherein the expression of the one or more endogenous GA20 oxidase and/or GA3 oxidase genes are reduced relative to a wildtype control plant, and a recombinant expression cassette comprising a DNA sequence encoding a CO or COL polypeptide, wherein the DNA sequence is operably linked to a plant-expressible promoter. In an aspect, the modified corn plants have increased yield relative to control corn plants. In another aspect, the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

Also provided is a genome edited or mutated corn plant comprising (1) a mutation or edit at or near an endogenous GA20 oxidase or GA3 oxidase gene, wherein the expression of the endogenous GA20 oxidase or GA3 oxidase gene is reduced relative to a wildtype control, and (2) a heterologous DNA sequence encoding a CO or COL polypeptide. In an aspect, the genome edited or mutated corn plant is semi-dwarf and has one or more improved ear traits, relative to a control corn plant that does not comprise both the mutation and the heterologous DNA sequence. In an aspect, a genome edited or mutated corn cell is obtained via a CRISPR based genome editing system.

Aspects of the present disclosure further include methods for making or producing modified plants, such as by genome editing, crossing, etc., wherein the method comprises editing the genomic locus of an endogenous GA3 or GA20 oxidase gene and introducing a transgene encoding one or more CO or COL polypeptide, and then regenerating or developing the modified plant from the edited plant cell.

In an aspect, a method comprises introducing a mutation or edit via CRISPR based genome editing at or near one or more endogenous GA3 or GA20 oxidase genes to reduce the expression of the one or more endogenous GA3 or GA20 oxidase genes. The method comprises creating a double-stranded break (DSB) in the genome of the plant cell, wherein a mutation or edit is introduced therein, thereby reducing the expression of the one or more endogenous GA3 or GA20 oxidase genes. In an aspect, the mutation or edit can be created (or integrated with a donor template) in a targeted manner into the genome of a cell at the location of a DSB via RNA-guided nucleases (e.g., Cas9 and Cpf1). In another aspect, a guide RNA recognizes a target site and acts in association with an RNA-guided nuclease that creates a DSB at the target site, wherein a mutation or edit is created (or integrated with a donor template) into the target site. In another aspect, the target site is near or at one or more endogenous GA3 or GA20 oxidase genes.

In an aspect, a method comprises introducing an insertion sequence encoding one or more CO or COL polypeptides into the genome of a plant cell via site-directed integration. Such a method comprises creating a DSB in the genome of the plant cell such that the insertion sequence is integrated at the site of the DSB. In an aspect, the insertion sequence encoding one or more CO or COL polypeptides can be inserted or integrated in a targeted manner into the genome of a cell at the location of a DSB via RNA-guided nucleases (e.g., Cas9 and Cpf1) in a CRISPR based genome editing system. In another aspect, a guide RNA recognizes a target site and acts in association with an RNA-guided nuclease that creates a double-stranded break at the target site, wherein the insertion sequence encoding one or more CO or COL polypeptides inserts or integrates into the target site.

In an aspect, an insertion sequence of a donor template of the present disclosure comprises a DNA sequence encoding a CO or COL polypeptide, wherein the CO or COL polypeptide sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 176-452 and a functional fragment thereof.

In an aspect, an insertion sequence of a donor template of the present disclosure comprises a DNA sequence encoding a PpCOL1 polypeptide, wherein the DNA sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169. In another aspect, an insertion sequence of the present disclosure comprises a DNA sequence encoding a polypeptide comprising an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a polypeptide or amino acid sequence selected from the group consisting of SEQ ID NO: 168, or a functional fragment thereof.

Provided in the present disclosure is a method for producing a modified corn plant, the method comprising: introducing into a corn cell a recombinant expression cassette comprising a DNA sequence encoding a CO or COL polypeptide, wherein the DNA sequence is operably linked to a plant-expressible promoter, and wherein the corn cell comprises one or more mutations and/or edits in one or more endogenous GA3 oxidase and/or GA20 oxidase genes; and regenerating or developing a modified corn plant from the corn cell, wherein the modified corn plant comprises the recombinant expression cassette and the one or more mutations and/or edits, and wherein the level of expression or activity of the one or more endogenous GA3 oxidase and/or GA20 oxidase genes in the modified corn plant is reduced relative to a control plant not having the one or more mutations and/or edits. In an aspect, the method further comprises introducing a recombinant DNA construct encoding a guide RNA that targets the one or more endogenous GA3 oxidase and/or GA20 oxidase genes.

In another aspect, the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of a target DNA sequence at or near the genomic locus of one or more endogenous GA3 oxidase and/or GA20 oxidase genes. In another aspect, In yet another aspect, the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 34, 35, 36, 37, or 38, or a sequence complementary thereto. In an aspect, the guide RNA is a CRISPR RNA (crRNA) or a single-chain guide RNA (sgRNA), or the guide RNA comprises a sequence complementary to a protospacer adjacent motif (PAM) sequence present in the genome of the corn cell immediately adjacent to a target DNA sequence at or near the genomic locus of the one or more endogenous GA3 oxidase and/or GA20 oxidase genes.

Also provided is a method for producing a genome edited or mutated corn plant, the method comprising: (a) introducing into a first corn cell a transgene that encodes one or more CO or COL polypeptides to create a genome edited or mutated corn cell, wherein the first corn cell has its expression of one or more endogenous GA3 oxidase genes or GA20 oxidase genes reduced relative to a wildtype control; and (b) generating a genome edited or mutated corn plant from the genome edited or mutated corn cell. In an aspect, the method further comprises identifying a genome edited or mutated corn plant with a desired trait. In another aspect, the identified genome edited or mutated corn plant is semi-dwarf and has one or more improved ear traits, relative to a control corn plant not having both the transgene and a reduced expression of one or more endogenous GA3 oxidase genes or GA20 oxidase genes.

In another aspect, the first corn cell of step (a) is obtained by being provided with a first guide RNA and a first RNA-guided nuclease, and wherein the genome edited or mutated corn cell of step (b) is obtained by being provided with a second guide RNA, an insertion sequence, and a second RNA-guided nuclease.

In another aspect, the first guide RNA recognizes a target site in a GA20 oxidase, wherein the first guide RNA acts in association with the first RNA-guided nuclease that creates a double-stranded break at the target site, and whereby the expression of the endogenous GA20 oxidase is reduced.

In another aspect, the method further comprises integrating into the double-stranded break at least one insertion, at least one substitution, at least one inversion, at least one deletion, at least one duplication, or a combination thereof.

In yet another aspect, the second guide RNA recognizes a target site and acts in association with the second RNA-guided nuclease that creates a double-stranded break at the target site, wherein the insertion sequence integrates into the target site, and wherein the donor/insertion sequence encodes a CO or COL polypeptide, such as PpCOL1 polypeptide.

Provided in the present disclosure is A method for producing a modified corn plant, the method comprising: mutating or editing one or more endogenous GA3 oxidase genes and/or one or more GA20 oxidase genes in a corn cell, wherein the corn cell comprises a recombinant expression cassette encoding a CO or COL polypeptide, wherein the DNA sequence is operably linked to a plant-expressible promoter; and regenerating or developing a modified corn plant from the corn cell, wherein the modified corn plant comprises the recombinant expression cassette and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

In an aspect, the mutating or editing is obtained by using a site-specific nuclease selected from the group consisting of a RNA-guided endonuclease, a meganuclease, a zinc-finger nuclease (ZFN), a TALE-endonuclease (TALEN), a recombinase, and a transposase. In another aspect, a method further comprises introducing a recombinant DNA construct encoding a guide RNA that targets the one or more endogenous GA3 oxidase and/or GA20 oxidase genes. In another aspect, the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of a target DNA sequence at or near the genomic locus of one or more endogenous GA3 oxidase and/or GA20 oxidase genes.

In another aspect, the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 34, 35, 36, 37, or 38, or a sequence complementary thereto. In another aspect, the guide RNA is a CRISPR RNA (crRNA) or a single-chain guide RNA (sgRNA). In yet another aspect, the guide RNA comprises a sequence complementary to a protospacer adjacent motif (PAM) sequence present in the genome of the corn cell immediately adjacent to a target DNA sequence at or near the genomic locus of the one or more endogenous GA3 oxidase and/or GA20 oxidase genes.

Also provided is a method for producing a genome edited or mutated corn plant, the method comprising: (a) reducing the expression of one or more endogenous GA3 oxidase genes or GA20 oxidase genes in a first corn cell to create a genome edited or mutated corn cell, wherein the first corn cell comprises a transgene that encodes one or more CO or COL polypeptides; and (b) generating a genome edited or mutated corn plant from the genome edited or mutated corn cell. In an aspect, the method further comprises identifying a genome edited or mutated corn plant with a desired trait. In another aspect, the identified genome edited or mutated corn plant is semi-dwarf and has one or more improved ear traits, relative to a control corn plant not having both the transgene and a reduced expression of one or more endogenous GA3 oxidase genes or GA20 oxidase genes.

In an aspect, the first corn cell of step (a) is obtained by being provided with a first guide RNA, an insertion sequence, and a first RNA-guided nuclease, and wherein the genome edited or mutated corn cell of step (b) is obtained by being provided with a second guide RNA and a second RNA-guided nuclease.

In another aspect, the first guide RNA recognizes a target site and acts in association with the first RNA-guided nuclease that creates a double-stranded break at the target site, wherein the insertion sequence integrates into the target site, and wherein the insertion sequence encodes a PpCOL1 polypeptide.

In another aspect, the second guide RNA recognizes a target site in a GA20 oxidase, wherein the second guide RNA acts in association with the second RNA-guided nuclease that creates a double-stranded break at the target site, and whereby the expression level of the endogenous GA20 oxidase is reduced.

The gRNA can be transformed or introduced into a plant cell or tissue (perhaps along with a nuclease, or nuclease-encoding DNA molecule, construct or vector) as a gRNA molecule, or as a recombinant DNA molecule, construct or vector comprising a transcribable DNA sequence encoding the guide RNA operably linked to a plant-expressible promoter. The guide sequence of the guide RNA can be at least 10 nucleotides in length, such as 12-40 nucleotides, 12-30 nucleotides, 12-20 nucleotides, 12-35 nucleotides, 12-30 nucleotides, 15-30 nucleotides, 17-30 nucleotides, or 17-25 nucleotides in length, or about 12, 13, 14, 15, 16, 17, 18, 19, 20, 21, 22, 23, 24, 25 or more nucleotides in length. The guide sequence can be at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of a DNA sequence at the genomic target site.

For genome editing at or near the GA20 oxidase_3 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 34 or a sequence complementary thereto (e.g., 12, 13, 14, 15, 16, 17, 18, 19, 20, 21, 22, 23, 24, 25 or more consecutive nucleotides of SEQ ID NO: 34 or a sequence complementary thereto).

For genome editing at or near the GA20 oxidase_4 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 38 or a sequence complementary thereto (e.g., 12, 13, 14, 15, 16, 17, 18, 19, 20, 21, 22, 23, 24, 25 or more consecutive nucleotides of SEQ ID NO: 38 or a sequence complementary thereto).

For genome editing at or near the GA20 oxidase_5 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 35 or a sequence complementary thereto (e.g., 10, 11, 12, 13, 14, 15, 16, 17, 18, 19, 20, 21, 22, 23, 24, 25 or more consecutive nucleotides of SEQ ID NO: 35 or a sequence complementary thereto).

In an aspect, a guide RNA for targeting an endogenous GA20 oxidase_3 and/or GA20 oxidase_5 gene is provided comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, or at least 21 consecutive nucleotides of any one or more of SEQ ID NOs: 138-167.

For genome editing at or near the GA3 oxidase_1 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 36 or a sequence complementary thereto (e.g., 10, 11, 12, 13, 14, 15, 16, 17, 18, 19, 20, 21, 22, 23, 24, 25 or more consecutive nucleotides of SEQ ID NO: 36 or a sequence complementary thereto).

For genome editing at or near the GA3 oxidase_2 gene with an RNA-guided endonuclease, a guide RNA can be used comprising a guide sequence that is at least 90%, at least 95%, at least 96%, at least 97%, at least 99% or 100% identical or complementary to at least 10, at least 11, at least 12, at least 13, at least 14, at least 15, at least 16, at least 17, at least 18, at least 19, at least 20, at least 21, at least 22, at least 23, at least 24, at least 25, or more consecutive nucleotides of SEQ ID NO: 37 or a sequence complementary thereto (e.g., 10, 11, 12, 13, 14, 15, 16, 17, 18, 19, 20, 21, 22, 23, 24, 25 or more consecutive nucleotides of SEQ ID NO: 37 or a sequence complementary thereto).

In an aspect, a guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 87, 91, 95, 98, 105, 109, 113, 117, 122, 126, 130 or 137, or a sequence complementary thereto.

In an aspect, a guide RNA comprises a sequence complementary to a protospacer adjacent motif (PAM) sequence present in the genome of a corn plant immediately adjacent to a target DNA sequence at or near the genomic locus of one or more endogenous GA20 or GA3 oxidase gene.

In addition to the guide sequence, a guide RNA can further comprise one or more other structural or scaffold sequence(s), which can bind or interact with an RNA-guided endonuclease. Such scaffold or structural sequences can further interact with other RNA molecules (e.g., tracrRNA). Methods and techniques for designing targeting constructs and guide RNAs for genome editing and site-directed integration at a target site within the genome of a plant using an RNA-guided endonuclease are known in the art.

Mutations such as deletions, insertions, inversions and/or substitutions can be introduced at a target site via imperfect repair of the DSB or nick to produce a knock-out or knock-down of a GA oxidase gene. Such mutations can be generated by imperfect repair of the targeted locus even without the use of a donor template molecule. A "knock-out" of a GA oxidase gene can be achieved by inducing a DSB or nick at or near the endogenous locus of the GA oxidase gene that results in non-expression of the GA oxidase protein or expression of a non-functional protein, whereas a "knock-down" of a GA oxidase gene can be achieved in a similar manner by inducing a DSB or nick at or near the endogenous locus of the GA oxidase gene that is repaired imperfectly at a site that does not affect the coding sequence of the GA oxidase gene in a manner that would eliminate the function of the encoded GA oxidase protein.

For example, the site of the DSB or nick within the endogenous locus can be in the upstream or 5' region of the GA oxidase gene (e.g., a promoter and/or enhancer sequence) to affect or reduce its level of expression. Similarly, such targeted knock-out or knock-down mutations of a GA oxidase gene can be generated with a donor template molecule to direct a particular or desired mutation at or near the target site via repair of the DSB or nick.

The donor template molecule can comprise a homologous sequence with or without an insertion sequence and comprising one or more mutations, such as one or more deletions, insertions, inversions and/or substitutions, relative to the targeted genomic sequence at or near the site of the DSB or nick. For example, targeted knock-out mutations of a GA oxidase gene can be achieved by deleting or inverting at least a portion of the gene or by introducing a frame shift or premature stop codon into the coding sequence of the gene. A deletion of a portion of a GA oxidase gene can also be introduced by generating DSBs or nicks at two target sites and causing a deletion of the intervening target region flanked by the target sites.

Provided herein is a recombinant DNA donor template molecule for site directed integration of an insertion sequence into the genome of a corn plant comprising an insertion sequence and at least one homology sequence, wherein the homology sequence is at least 70%, at least 75%, at least 80%, at least 85%, at least 90%, at least 95%, at least 96%, at least 97%, at least 99% or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a target DNA sequence in the genome of a corn plant cell, and wherein the insertion sequence comprises an expression cassette comprising a DNA sequence encoding a CO or COL polypeptide, wherein the DNA sequence is operably linked to a plant-expressible promoter.

In an aspect, the DNA donor template molecule comprises two of the homology sequences, wherein the two homology sequences flank the insertion sequence. In another aspect, the CO or COL polypeptide comprises an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397. In another aspect, the CO or COL polypeptide comprises an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

In another aspect, the CO or COL polypeptide comprises a *Physcomitrella patens* CONSTANS-like 1 (PpCOL1) polypeptide. In another aspect, the DNA sequence comprised in the expression cassette comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169. In another aspect, the CO or COL polypeptide comprises an amino acid sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168, or a functional fragment thereof. In another aspect, a plant-expressible promoter comprises a DNA sequence that is at least 80%, at least 85%, at least 90%, at least 95%, at least 96%, at least 97%, at least 98%, at least 99%, at least 99.5% or 100% identical to one or more of SEQ ID NOs: 170-172 or a functional portion thereof.

In another aspect, a DNA donor template molecule further comprises a transcribable DNA sequence encoding a non-coding RNA for suppression of one or more GA20 oxidase genes and/or one or more GA3 oxidase genes, wherein the transcribable DNA sequence is operably linked to a promoter.

In an aspect, a donor template comprising at least one homology sequence or homology arm, wherein the at least one homology sequence or homology arm is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a target DNA sequence, wherein the target DNA sequence is a genomic sequence at or near the genomic locus of an endogenous GA oxidase gene of a corn or cereal plant.

In another aspect, the at least one homology sequence is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of SEQ ID NO: 34, 35, 36, 37, or 38, or a sequence complementary thereto.

In an aspect, a donor template comprising two homology arms including a first homology arm and a second homology arm, wherein the first homology arm comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a first flanking DNA sequence, wherein the second homology arm comprises a sequence that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a second flanking DNA sequence, and wherein the first flanking DNA sequence and the second flanking DNA sequence are genomic sequences at or near the genomic locus of an endogenous GA oxidase gene of a corn or cereal plant.

In another aspect, each of the two homology arms is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical or complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of SEQ ID NO: 34, 35, 36, 37, or 38, or a sequence complementary thereto.

In another aspect, the method further comprises integrating into the double-stranded break at least one insertion, at least one substitution, at least one inversion, at least one deletion, at least one duplication, or a combination thereof.

In yet another aspect, an insertion sequence of a donor template comprises a sequence encoding a protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 168 and 176-452 and a functional fragment thereof.

Further provided is a method for producing a modified corn plant, the method comprising: (a) crossing a first corn plant with a second corn plant to create a modified corn plant, wherein the expression of one or more endogenous GA3 oxidase genes or GA20 oxidase genes is reduced in the first corn plant relative to a wildtype control, and wherein the second corn plant comprising a transgene encoding one or more CO or COL polypeptides; and (b) producing an offspring of the modified corn plant of step (a). In an aspect, the method further comprises identifying a modified corn plant with a desired trait. In another aspect, the identified modified corn plant is semi-dwarf and has one or more improved ear traits, relative to a control corn plant not having both the transgene and a reduced expression of one or more endogenous GA3 oxidase genes or GA20 oxidase genes.

In an aspect, a target site can comprise at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 29, or at least 30 consecutive nucleotides.

In an aspect, the target site is a GA3 oxidase_1 gene. In another aspect, the target site is a GA3 oxidase_2 gene. In yet another aspect, the target site is a combination of the GA3 oxidase_1 and GA3 oxidase_2 genes. In still another aspect, the target site is within the open reading frame of the GA3 oxidase_1 or GA3 oxidase_2 gene. In still another aspect, the target site is within the promoter/enhancer of the GA3 oxidase_1 or GA3 oxidase_2 gene. In still another aspect, the target site is within the intron of the GA3 oxidase_1 or GA3 oxidase_2 gene. In still another aspect, the target site is within the 5'UTR of the GA3 oxidase_11 or GA3 oxidase_2 gene. In still another aspect, the target site is within the 3'UTR of the GA3 oxidase_1 or GA3 oxidase_2 gene.

In an aspect, the target site is a GA20 oxidase_3 gene. In another aspect, the target site is a GA20 oxidase_4 gene. In another aspect, the target site is a GA20 oxidase_5 gene. In yet another aspect, the target site is a combination of the GA20 oxidase_3 gene, GA20 oxidase_4 gene, and GA20 oxidase_5 gene. In still another aspect, the target site is within the open reading frame of the GA20 oxidase_3, GA20 oxidase_4, or GA20 oxidase_5 gene. In still another aspect, the target site is within the promoter/enhancer of the GA20 oxidase_3, GA20 oxidase_4, or GA20 oxidase_5 gene. In still another aspect, the target site is within the intron of the GA20 oxidase_3, GA20 oxidase_4, or GA20 oxidase_5 gene. In still another aspect, the target site is within the 5'UTR of the GA20 oxidase_3, GA20 oxidase_4, or GA20 oxidase_5 gene. In still another aspect, the target site is within the 3'UTR of the GA20 oxidase_3, GA20 oxidase_4, or GA20 oxidase_5 gene.

In an aspect, the target site comprises a nucleotide sequence selected from the group consisting of SEQ ID NOs: 34, 35, and 38.

A targeted genome editing technique provided herein can comprise the use of one or more, two or more, three or more, four or more, or five or more donor molecules or templates. A "donor template" can be a single-stranded or double-stranded DNA or RNA molecule or plasmid.

According to other aspects, an insertion sequence of a donor template can comprise a transcribable DNA sequence that encodes a non-coding RNA molecule, which targets one or more GA oxidase gene(s), such as a GA3 oxidase or GA20 oxidase gene(s), for suppression. In an aspect, the transcribable DNA sequence that encodes a non-coding RNA for the suppression of the GA3 oxidase and/or GA20 oxidase gene(s) is selected from the group consisting of SEQ ID NOs: 35-38. In another aspect, an insertion sequence of a donor template can comprise a DNA sequence encoding one or more CO or COL polypeptides, wherein the DNA sequence encodes protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 168 and a functional fragment thereof. In another aspect, an insertion sequence of a donor template can comprise a DNA sequence encoding one or more CO or COL polypeptides, wherein the DNA sequence encodes protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 176-452 and a functional fragment thereof. In yet another aspect, an insertion sequence of a donor template can comprise a first transcribable DNA sequence encoding a non-coding RNA molecule for the suppression of the one or more GA3 oxidase or GA20 oxidase gene(s), wherein the first transcribable DNA sequence is selected from the group consisting of SEQ ID NOs: 35-38; and an insertion sequence of a donor template can comprise a second DNA sequence encoding one or more CO or COL polypeptides, wherein the second DNA sequence encodes a protein that is at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to a sequence selected from the group consisting of SEQ ID NOs: 168, 176-452, and a functional fragment thereof.

An insertion sequence provided herein can be of any length. For example, a donor or insertion sequence provided herein is between 2 and 50,000, between 2 and 10,000, between 2 and 5000, between 2 and 1000, between 2 and 500, between 2 and 250, between 2 and 100, between 2 and 50, between 2 and 30, between 15 and 50, between 15 and 100, between 15 and 500, between 15 and 1000, between 15 and 5000, between 18 and 30, between 18 and 26, between 20 and 26, between 20 and 50, between 20 and 100, between 20 and 250, between 20 and 500, between 20 and 1000, between 20 and 5000 or between 20 and 10,000 nucleotides in length.

In an aspect, a sequence can be inserted into a double-stranded break created by a CRISPR based genome editing system without the presence of a donor template. In an aspect, at least one insertion, at least one substitution, at least one deletion, at least one duplication, and/or at least one inversion can be inserted/introduced into a double-stranded break created by a CRISPR based genome editing system via non-homologous end joining (NHEJ) without a donor template. In an aspect, at least one insertion, at least one substitution, at least one deletion, at least one duplication, and/or at least one inversion can be inserted/introduced into a double-stranded break created by a CRISPR based genome editing system via homologous recombination (HR) with a donor template.

According to other aspects, at least one insertion is integrated into the double-stranded break at the GA3 oxidase or GA20 oxidase locus and introduces a premature stop codon therein which leads to truncation of the GA3 oxidase or GA20 oxidase proteins and subsequent suppression of the GA3 oxidase or GA20 oxidase genes. In an aspect, the at least one insertion is a single nucleobase insertion. In another aspect, the single nucleobase insertion is selected from the group consisting of guanine, cytosine, adenine, thymine, and uracil. In an aspect, the at least one insertion is inserted within the open reading frame of the GA3 oxidase or GA20 oxidase gene. In another aspect, the at least one insertion is inserted within the promoter/enhancer, intron, 5'UTR, 3'UTR, or a combination thereof.

In another aspect, the at least one insertion at the GA3 oxidase or GA20 oxidase locus comprises at least 2 nucleotides, at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, or at least 20 nucleotides.

According to an aspect, at least one substitution is integrated into the double-stranded break at the GA3 oxidase or GA20 oxidase locus that leads to the suppression of the GA3 oxidase or GA20 oxidase gene. In an aspect, the at least one substitution is integrated within the open reading frame of the GA3 oxidase or GA20 oxidase gene. In another aspect, the at least one substitution is integrated within the promoter/enhancer, intron, 5'UTR, 3'UTR, or a combination thereof.

According to an aspect, at least one deletion is introduced into the double-stranded break at the GA3 oxidase or GA20 oxidase locus that leads to the suppression of the GA3 oxidase or GA20 oxidase gene. In an aspect, the at least one deletion is introduced within the open reading frame of the GA3 oxidase or GA20 oxidase gene. In another aspect, the at least one deletion is introduced within the promoter/enhancer, intron, 5'UTR, 3'UTR, or a combination thereof.

According to an aspect, at least one duplication is introduced into the double-stranded break at the GA3 oxidase or GA20 oxidase locus that leads to the suppression of the GA3 oxidase or GA20 oxidase gene. In an aspect, the at least one duplication is introduced within the open reading frame of the GA3 oxidase or GA20 oxidase gene. In another aspect, the at least one duplication is introduced within the promoter/enhancer, intron, 5'UTR, 3'UTR, or a combination thereof.

According to an aspect, at least one inversion is integrated into the double-stranded break at the GA3 oxidase or GA20 oxidase locus that leads to the suppression of the GA3 oxidase or GA20 oxidase gene. In an aspect, the at least one inversion is integrated within the open reading frame of the GA3 oxidase or GA20 oxidase gene. In another aspect, the at least one inversion is integrated within the promoter/enhancer, intron, 5'UTR, 3'UTR, or a combination thereof.

According to an aspect, a recombinant DNA construct or vector can comprise a first polynucleotide sequence encoding a site-specific nuclease and a second polynucleotide sequence encoding a guide RNA that can be introduced into a plant cell together via plant transformation techniques. Alternatively, two recombinant DNA constructs or vectors can be provided including a first recombinant DNA construct or vector and a second DNA construct or vector that can be introduced into a plant cell together or sequentially via plant transformation techniques, where the first recombinant DNA construct or vector comprises a polynucleotide sequence encoding a site-specific nuclease and the second recombinant DNA construct or vector comprises a polynucleotide sequence encoding a guide RNA.

According to an aspect, a recombinant DNA construct or vector comprising a polynucleotide sequence encoding a site-specific nuclease can be introduced via plant transformation techniques into a plant cell that already comprises (or is transformed with) a recombinant DNA construct or vector comprising a polynucleotide sequence encoding a guide RNA. Alternatively, a recombinant DNA construct or vector comprising a polynucleotide sequence encoding a guide RNA can be introduced via plant transformation techniques into a plant cell that already comprises (or is transformed with) a recombinant DNA construct or vector comprising a polynucleotide sequence encoding a site-specific nuclease. According to yet further aspects, a first plant comprising (or transformed with) a recombinant DNA construct or vector comprising a polynucleotide sequence encoding a site-specific nuclease can be crossed with a second plant comprising (or transformed with) a recombinant DNA construct or vector comprising a polynucleotide sequence encoding a guide RNA. Such recombinant DNA constructs or vectors can be transiently transformed into a plant cell or stably transformed or integrated into the genome of a plant cell.

In an aspect, vectors comprising polynucleotides encoding a site-specific nuclease, and optionally one or more, two or more, three or more, or four or more gRNAs are provided to a plant cell by transformation methods known in the art (e.g., without being limiting, particle bombardment, PEG-mediated protoplast transfection or *Agrobacterium*-mediated transformation). In an aspect, vectors comprising polynucleotides encoding a Cas9 nuclease, and optionally one or more, two or more, three or more, or four or more gRNAs are provided to a plant cell by transformation methods known in the art (e.g., without being limiting, particle bombardment, PEG-mediated protoplast transfection or *Agrobacterium*-mediated transformation). In another aspect, vectors comprising polynucleotides encoding a Cpf1 and, optionally one or more, two or more, three or more, or four or more crRNAs are provided to a cell by transformation methods known in the art (e.g., without being limiting, viral transfection, particle bombardment, PEG-mediated protoplast transfection or *Agrobacterium*-mediated transformation).

Dwarf or semi-dwarf corn disclosed herein can have characteristics that make it suitable for grain and forage production, especially, production in short-season environments. In particular, limited heat units in short-season environments reduce grain yield and lessen the probability of the crop reaching physiological maturity in a given year. The disclosed dwarf or semi-dwarf corn plants require fewer heat units (e.g., required 10%) than conventional hybrids to reach anthesis and generally reach physiological maturity earlier than conventional cultivars. Semi-dwarf corn plants disclosed herein are less prone to stalk and root lodging due to the shorter stalks and lower ear placement. Corn plants disclosed herein also have the potential to produce high-quality forage due to its high ear-to-stover ratio.

Short stature or semi-dwarf corn plants can also have one or more additional traits, including, but not limited to, increased stem diameter, reduced green snap, deeper roots, increased leaf area, earlier canopy closure, higher stomatal conductance, lower ear height, increased foliar water content, improved drought tolerance, increased nitrogen use efficiency, increased water use efficiency, reduced anthocyanin content and area in leaves under normal or nitrogen or water limiting stress conditions, increased ear weight, increased kernel number, increased kernel weight, increased yield, increased seed number, increased seed weight, and increased prolificacy, and/or increased harvest index.

According to aspects of the present disclosure, modified, transgenic, or genome edited/mutated cereal or corn plants are provided that have at least one beneficial agronomic trait and at least one female reproductive organ or ear that is substantially or completely free of off-types. The beneficial agronomic trait can include, but is not limited to, shorter plant height, shorter internode length in one or more internode(s), larger (thicker) stem or stalk diameter, increased lodging resistance, improved drought tolerance, increased nitrogen use efficiency, increased water use efficiency, deeper roots, larger leaf area, earlier canopy closure, and/or increased harvestable yield. As used herein, "harvest index" refers to the mass of the harvested grain divided by the total mass of the above-ground biomass of the plant over a harvested area.

In an aspect, a modified, transgenic, or genome edited/mutated corn plant exhibits improved lodging resistance, reduced green snap, or both, relative to a control corn plant.

In an aspect, the height at maturity of a modified, transgenic, or genome edited/mutated corn plant exhibiting semi-dwarf phenotype is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, at least 70%, or at least 75%, relative to a control corn plant grown under comparable conditions.

According to another aspect of the present disclosure, a modified, transgenic, or genome edited/mutated corn plant provided herein comprises a height that is between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 15%, between 1% and 10%, between 1% and 5%, or between 1% and 2%, of that of a control plant grown under comparable conditions.

According to another aspect of the present disclosure, a modified, transgenic, or genome edited/mutated corn plant provided herein comprises a height that is between 2% and 75%, between 5% and 75%, between 10% and 75%, between 15% and 75%, between 20% and 75%, between 25% and 75%, between 30% and 75%, between 35% and 75%, between 40% and 75%, between 45% and 75%, between 50% and 75%, between 55% and 75%, between 60% and 75%, between 65% and 75%, or between 70% and 75%, of that of a control plant grown under comparable conditions.

According to another aspect of the present disclosure, a modified, transgenic, or genome edited/mutated corn plant provided herein comprises a height that is between 2% and 70%, between 5% and 65%, between 10% and 60%, between 15% and 55%, between 20% and 50%, between 25% and 45%, or between 30% and 40%, of that of a control plant grown under comparable conditions.

According to another aspect of the present disclosure, a modified, transgenic, or genome edited/mutated corn plant provided herein comprises a height that is between 1% and 10%, between 10% and 20%, between 20% and 30%, between 30% and 40%, between 40% and 50%, between 50% and 60%, between 60% and 70%, or between 70% and 80%, of that of a control plant grown under comparable conditions.

In an aspect, the stalk or stem diameter of a transgenic corn plant or genome edited/mutated corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plan grown under comparable conditions.

According to another aspect of the present disclosure, a modified, transgenic, or genome edited/mutated corn plant provided herein comprises a stalk or stem diameter that is between 0.1% and 100%, between 0.2% and 100%, between 0.5% and 100%, between 1% and 100%, between 1.5% and 100%, between 2% and 100%, between 2.5% and 100%, between 3% and 100%, between 3.5% and 100%, between 4% and 100%, between 4.5% and 100%, between 5% and 100%, between 6% and 100%, between 7% and 100%, between 8% and 100%, between 9% and 100%, between 10% and 100%, between 15% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100%, greater than that of a control corn plan grown under comparable conditions.

According to another aspect of the present disclosure, a modified, transgenic, or genome edited/mutated corn plant provided herein comprises a stalk or stem diameter that is between 0.1% and 95%, between 0.1% and 90%, between 0.1% and 85%, between 0.1% and 80%, between 0.1% and 75%, between 0.1% and 70%, between 0.1% and 65%, between 0.1% and 60%, between 0.1% and 55%, between 0.1% and 50%, between 0.1% and 45%, between 0.1% and 40%, between 0.1% and 35%, between 0.1% and 30%, between 0.1% and 25%, between 0.1% and 20%, between 0.1% and 15%, between 0.1% and 10%, between 0.1% and 9%, between 0.1% and 8%, between 0.1% and 7%, between 0.1% and 6%, between 0.1% and 5%, between 0.1% and 4.5%, between 0.1% and 4%, between 0.1% and 3.5%, between 0.1% and 3%, between 0.1% and 2.5%, between 0.1% and 2%, between 0.1% and 1.5%, between 0.1% and 1%, between 0.1% and 0.5%, or between 0.1% and 0.2%, greater than that that of a control corn plan grown under comparable conditions.

According to another aspect of the present disclosure, a modified, transgenic, or genome edited/mutated corn plant provided herein comprises a stalk or stem diameter that is between 0.2% and 95%, between 0.5% and 90%, between 1% and 85%, between 1.5% and 80%, between 2% and 75%, between 2.5% and 70%, between 3% and 65%, between 3.5% and 60%, between 4% and 55%, between 4.5% and 50%, between 5% and 45%, between 6% and 40%, between 7% and 35%, between 8% and 30%, between 9% and 25%, or between 10% and 20%, greater than that that of a control corn plan grown under comparable conditions.

According to another aspect of the present disclosure, a modified, transgenic, or genome edited/mutated corn plant provided herein comprises a stalk or stem diameter that is between 0.1% and 1%, between 1% and 5%, between 6% and 10%, between 20% and 30%, between 30% and 40%, between 40% and 50%, between 50% and 60%, between 60% and 70%, between 70% and 80%, between 80% and 90%, between 90% and 100%, greater than that that of a control corn plan grown under comparable conditions.

In another aspect, the yield of a modified, transgenic, or genome edited/mutated exhibiting semi-dwarf phenotype is equal to or more then the yield of a control plant grown under comparable conditions.

In another aspect, a modified, transgenic, or genome edited/mutated corn plant exhibiting semi-dwarf phenotype requires about 5%, 10%, 15%, 20%, or 25% fewer heat units than a control plant to reach anthesis.

In yet another aspect, a modified, transgenic, or genome edited/mutated corn plant exhibiting semi-dwarf phenotype has a relative maturity of about 10%, 15%, 20%, 25%, 30%, 35%, 40%, or 45% fewer days than the relative maturity of a control plant grown under comparable conditions.

According to an aspect of the present disclosure, a modified, transgenic, or genome edited/mutated corn plant provided herein comprises a height of less than 2000 mm, less than 1950 mm, less than 1900 mm, less than 1850 mm, less than 1800 mm, less than 1750 mm, less than 1700 mm, less than 1650 mm, less than 1600 mm, less than 1550 mm, less than 1500 mm, less than 1450 mm, less than 1400 mm, less than 1350 mm, less than 1300 mm, less than 1250 mm, less than 1200 mm, less than 1150 mm, less than 1100 mm, less than 1050 mm, or less than 1000 mm and an average stem diameter of at least 17.5 mm, at least 18 mm, at least 18.5 mm, at least 19 mm, at least 19.5 mm, at least 20 mm, at least 20.5 mm, at least 21 mm, at least 21.5 mm, or at least 22 mm. According to another aspect the modified corn plant further comprises at least one ear that is substantially free of mature male reproductive tissue.

According to aspects of the present disclosure, modified, transgenic, or genome edited/mutated corn plants are provided that comprise a plant height during late vegetative and/or reproductive stages of development (e.g., at R3 stage) of between 1000 mm and 1800 mm, between 1000 mm and 1700 mm, between 1050 mm and 1700 mm, between 1100 mm and 1700 mm, between 1150 mm and 1700 mm, between 1200 mm and 1700 mm, between 1250 mm and 1700 mm, between 1300 mm and 1700 mm, between 1350 mm and 1700 mm, between 1400 mm and 1700 mm, between 1450 mm and 1700 mm, between 1000 mm and 1500 mm, between 1050 mm and 1500 mm, between 1100 mm and 1500 mm, between 1150 mm and 1500 mm, between 1200 mm and 1500 mm, between 1250 mm and 1500 mm, between 1300 mm and 1500 mm, between 1350 mm and 1500 mm, between 1400 mm and 1500 mm, between 1450 mm and 1500 mm, between 1000 mm and 1600 mm, between 1100 mm and 1600 mm, between 1200 mm and 1600 mm, between 1300 mm and 1600 mm, between 1350 mm and 1600 mm, between 1400 mm and 1600 mm, between 1450 mm and 1600 mm, of between 1000 mm and 2000 mm, between 1200 mm and 2000 mm, between 1200 mm and 1800 mm, between 1300 mm and 1700 mm, between 1400 mm and 1700 mm, between 1400 mm and 1600 mm, between 1400 mm and 1700 mm, between 1400 mm and 1800 mm, between 1400 mm and 1900 mm, between 1400 mm and 2000 mm, or between 1200 mm and 2500 mm, and/or an average stem diameter of between 17.5 mm and 22 mm, between 18 mm and 22 mm, between 18.5 and 22 mm, between 19 mm and 22 mm, between 19.5 mm and 22 mm, between 20 mm and 22 mm, between 20.5 mm and 22 mm, between 21 mm and 22 mm, between 21.5 mm and 22 mm, between 17.5 mm and 21 mm, between 17.5 mm and 20 mm, between 17.5 mm and 19 mm, between 17.5 mm and 18 mm, between 18 mm and 21 mm, between 18 mm and 20 mm, or between 18 mm and 19 mm. A modified corn plant can be substantially free of off-types, such as male reproductive tissues or structures in one or more ears of the modified corn plant.

According to an aspect of the present disclosure a modified, transgenic, or genome edited/mutated corn plant provided herein comprises a height of between 1000 mm and 1600 mm, 1000 mm and 1500 mm, between 1050 mm and 1500 mm, between 1100 mm and 1500 mm, between 1150 mm and 1500 mm, between 1200 mm and 1500 mm, between 1250 mm and 1500 mm, between 1300 mm and 1500 mm, between 1350 mm and 1500 mm, between 1400 mm and 1500 mm, between 1450 mm and 1500 mm, between 1000 mm and 1600 mm, between 1100 mm and 1600 mm, between 1200 mm and 1600 mm, between 1300 mm and 1600 mm, or between 1000 mm and 1300 mm, and an average stem diameter of between 17.5 mm and 22 mm, between 18 mm and 22 mm, between 18.5 and 22 mm, between 19 mm and 22 mm, between 19.5 mm and 22 mm, between 20 mm and 22 mm, between 20.5 mm and 22 mm, between 21 mm and 22 mm, between 21.5 mm and 22 mm, between 17.5 mm and 21 mm, between 17.5 mm and 20 mm, between 17.5 mm and 19 mm, between 17.5 mm and 18 mm, between 18 mm and 21 mm, between 18 mm and 20 mm, or between 18 mm and 19 mm. According to another aspect the modified corn plant further comprises at least one ear that is substantially free of mature male reproductive tissue.

According to an aspect of the present disclosure, a modified, transgenic, or genome edited/mutated corn plant provided herein comprises a height that is at least 5%, at least 10%, at least 15%, at least 20%, at least 25%, at least 30%, at least 35%, at least 40%, at least 45%, at least 50%, at least 55%, at least 60%, at least 65%, at least 70%, or at least 75% less than the height of a control plant and a stalk or stem diameter that is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% greater than the stem diameter of a control plant.

According to an aspect of the present disclosure, a modified, transgenic, or genome edited/mutated corn plant provided herein comprises a fresh ear weight that is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% greater than the fresh ear weight of a control plant.

According to an aspect of the present disclosure, a population of modified, transgenic, or genome edited/mutated corn plants provided herein comprises a lodging frequency that is at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100% lower as compared to a population of unmodified control plants. According to another aspect of the present disclosure, a population of modified corn plants provided herein comprises a lodging frequency that is between 5% and 100%, between 5% and 95%, between 5% and 90%, between 5% and 85%, between 5% and 80%, between 5% and 75%, between 5% and 70%, between 5% and 65%, between 5% and 60%, between 5% and 55%, between 5% and 50%, between 5% and 45%, between 5% and 40%, between 5% and 35%, between 5% and 30%, between 5% and 25%, between 5% and 20%, between 5% and 15%, between 5% and 10%, between 10% and 100%, between 10% and 75%, between 10% and 50%, between 25% and 75%, between 25% and 50%, or between 50% and 75% lower as compared to a population of control plants.

According to an aspect of the present disclosure, modified, transgenic, or genome edited/mutated corn plants are provided that comprise an average internode length (or a minus-2 internode length and/or minus-4 internode length relative to the position of the ear) that is at least 5%, at least 10%, at least 15%, at least 20%, at least 25%, at least 30%, at least 35%, at least 40%, at least 45%, at least 50%, at least 55%, at least 60%, at least 65%, at least 70%, or at least 75% less than the same or average internode length of a control plant.

The "minus-2 internode" of a corn plant refers to the second internode below the ear of the plant, and the "minus-4 internode" of a corn plant refers to the fourth internode below the ear of the plant. According to many aspects, modified, transgenic, or genome edited/mutated corn plants are provided that have an average internode length (or a minus-2 internode length and/or minus-4 internode length relative to the position of the ear) that is between 5% and 75%, between 5% and 50%, between 10% and 70%, between 10% and 65%, between 10% and 60%, between 10% and 55%, between 10% and 50%, between 10% and 45%, between 10% and 40%, between 10% and 35%, between 10% and 30%, between 10% and 25%, between 10% and 20%, between 10% and 15%, between 10% and 10%, between 10% and 75%, between 25% and 75%, between 10% and 50%, between 20% and 50%, between 25% and 50%, between 30% and 75%, between 30% and 50%, between 25% and 50%, between 15% and 50%, between 20% and 50%, between 25% and 45%, or between 30% and 45% less than the same or average internode length of a control plant.

A modified, transgenic, or genome edited/mutated corn plant can have a harvest index that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 20%, at least 25%, at least 30%, at least 35%, at least 40%, at least 45%, or at least 50% greater than the harvest index of a wild-type or control plant. A modified corn plant can have a harvest index that is between 1% and 45%, between 1% and 40%, between 1% and 35%, between 1% and 30%, between 1% and 25%, between 1% and 20%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, between 1% and 2%, between 5% and 15%, between 5% and 20%, between 5% and 30%, or between 5% and 40% greater than the harvest index of a control plant.

According to an aspect of the present disclosure, modified, transgenic, or genome edited/mutated corn plants are provided that have an increase in harvestable yield of at least 1 bushel per acre, at least 2 bushels per acre, at least 3 bushels per acre, at least 4 bushels per acre, at least 5 bushels per acre, at least 6 bushels per acre, at least 7 bushels per acre, at least 8 bushels per acre, at least 9 bushels per acre, or at least 10 bushels per acre, relative to a wild-type or control plant. A modified corn plant can have an increase in harvestable yield between 1 and 10, between 1 and 8, between 2 and 8, between 2 and 6, between 2 and 5, between 2.5 and 4.5, or between 3 and 4 bushels per acre. A modified corn plant can have an increase in harvestable yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 20%, or at least 25% greater than the harvestable yield of a wild-type or control plant. A modified corn plant can have a harvestable yield that is between 1% and 25%, between 1% and 20%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, between 1% and 2%, between 5% and 15%, between 5% and 20%, between 5% and 25%, between 2% and 10%, between 2% and 9%, between 2% and 8%, between 2% and 7%, between 2% and 6%, between 2% and 5%, or between 2% and 4% greater than the harvestable yield of a control plant.

According to an aspect, the present disclosure provides a population of a modified, transgenic, or genome edited/mutated corn plants, where the population of a modified, transgenic, or genome edited/mutated corn plants shares ancestry with a single a modified, transgenic, or genome edited/mutated corn plant, where the population of a modified, transgenic, or genome edited/mutated corn plants comprises an average height of 1500 mm or less, wherein the population of a modified, transgenic, or genome edited/mutated corn plants comprises an average stalk or stem diameter of 18 mm or more, wherein less than 5%, less than 10%, less than 15%, less than 20%, or less than 25% of the population of modified, transgenic, or genome edited/mutated corn plants comprises a height of greater than 1500 mm, and where less than 5%, less than 10%, less than 15%, less than 20%, or less than 25% of the population of a modified, transgenic, or genome edited/mutated corn plants comprises at least one ear comprising mature male reproductive tissue. In another aspect the population of a modified, transgenic, or genome edited/mutated corn plants comprises an average height of 1200 mm or less.

According to an aspect, the present disclosure provides a population of a modified, transgenic, or genome edited/mutated corn plants, where the population of a modified, transgenic, or genome edited/mutated corn plants share ancestry with a single modified corn plant, where the population of a modified, transgenic, or genome edited/mutated corn plants comprises an average height of 1500 mm or less, where less than 5%, less than 10%, less than 15%, less than 20%, or less than 25% of the population of modified corn plants comprises a height of greater than 1500 mm, and where the population of a modified, transgenic, or genome edited/mutated corn plants comprises a lodging frequency that is at least 5%, at least 10%, at least 20%, at least 30%, at least 40%, at least 50%, at least 60%, at least 70% at least 80%, at least 90%, or 100% lower as compared to a population of control corn plants.

According to an aspect, the present disclosure provides a modified, transgenic, or genome edited/mutated corn plant comprising a height of 1500 mm or less, where the a modified, transgenic, or genome edited/mutated corn plant further comprises a stalk or stem diameter of 18 mm or more, and where at least one ear of the a modified, transgenic, or genome edited/mutated corn plant is substantially free of mature male reproductive tissue.

According to an aspect, the present disclosure provides a modified, transgenic, or genome edited/mutated corn plant comprising a height of 1500 mm or less, wherein the a modified, transgenic, or genome edited/mutated corn plant further comprises a harvest index of at least 0.58, and where the a modified, transgenic, or genome edited/mutated corn plant further comprises at least one ear that is substantially free of mature male reproductive tissue.

According to an aspect of the present disclosure, modified, transgenic, or genome edited/mutated corn plants are provided having a significantly reduced or eliminated expression level of one or more GA3 oxidase and/or GA20 oxidase gene transcript(s) and/or protein(s) in one or more tissue(s), such as one or more stem, internode, leaf and/or vascular tissue(s), of the modified, transgenic, or genome edited/mutated plants, as compared to the same tissue(s) of wild-type or control plants. In an aspect, the level of one or more GA3 oxidase and/or GA20 oxidase gene transcript(s) and/or protein(s), or one or more GA oxidase (or GA oxidase-like) gene transcript(s) and/or protein(s), in one or more stem, internode, leaf and/or vascular tissue(s) of a modified corn plant can be at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% less or lower than in the same tissue(s) of a control corn or cereal plant.

According to an aspect of the present disclosure, modified, transgenic, or genome edited/mutated cereal or corn plants are provided that have at least one beneficial agronomic trait and at least one female reproductive organ or ear that is substantially or completely free of off-types. The beneficial agronomic trait can include, for example, shorter plant height, shorter internode length in one or more internode(s), larger (thicker) stem or stalk diameter, increased lodging resistance, improved drought tolerance, increased nitrogen use efficiency, increased water use efficiency, deeper roots, larger leaf area, earlier canopy closure, and/or increased harvestable yield. A modified, transgenic, or genome edited/mutated cereal or corn plant can have a female reproductive organ or ear that appears normal relative to a control or wild-type plant. Indeed, modified, transgenic, or genome edited/mutated cereal or corn plants are provided that comprise at least one reproductive organ or ear that does not have or exhibit, or is substantially or completely free of, off-types including male sterility, reduced kernel or seed number, and/or masculinized structure(s) in one or more female organs or ears.

A modified, transgenic, or genome edited/mutated cereal or corn plant is provided herein that lacks significant off-types in the reproductive tissues of the plant. Off-types can include male (tassel or anther) sterility, reduced kernel or seed number, and/or the presence of one or more masculinized or male (or male-like) reproductive structures in the female organ or ear (e.g., anther ear) of the plant.

As used herein, a female organ or ear of a plant, such as corn, is "substantially free" of male reproductive structures if male reproductive structures are absent or nearly absent in the female organ or ear of the plant based on visual inspection of the female organ or ear at later reproductive stages. A female organ or ear of a plant, such as corn, is "completely free" of mature male reproductive structures if male reproductive structures are absent or not observed or observable in the female organ or ear of the plant, such as a corn plant, by visual inspection of the female organ or ear at later reproductive stages.

In an aspect, a modified, transgenic, or genome edited/ mutated corn plant exhibits increased ear area relative to a control corn plant.

According to an aspect of the present disclosure, a modified, transgenic, or genome edited/mutated corn plant exhibits an increase in ear area by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear area that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits an ear area that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits an ear area that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits an ear area that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

In an aspect, a modified, transgenic, or genome edited/ mutated corn plant exhibits increased ear volume relative to a control corn plant grown under comparable conditions.

According to an aspect of the present disclosure, a modified, transgenic, or genome edited/mutated corn plant exhibits an increase in ear volume by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear volume that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits an ear volume that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits an ear volume that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits an ear volume that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

In an aspect, a modified, transgenic, or genome edited/mutated corn plant exhibits increased ear diameter relative to a control corn plant grown under comparable conditions.

According to an aspect of the present disclosure, a modified, transgenic, or genome edited/mutated corn plant exhibits an ear diameter that is at least 0.2%, at least 0.4%, at least 0.6%, at least 0.8%, at least 1.0%, at least 1.2%, at least 1.4%, at least 1.6%, at least 1.8%, at least 2.0%, at least 2.2%, at least 2.4%, at least 2.6%, at least 2.8%, at least 3.0%, at least 3.2%, at least 3.4%, at least 3.6%, at least 3.8%, at least 4.0%, at least 4.5%, at least 5.0%, at least 5.5%, at least 6.0%, at least 6.5%, at least 7.0%, at least 7.5%, at least 8.0%, at least 8.5%, at least 9.0%, at least 9.5%, at least 10.0%, relative to a control corn plant.

According to an aspect of the present disclosure, a modified, transgenic, or genome edited/mutated corn plant exhibits an ear diameter that is between 0.2% and 10.0%, between 0.4% and 10.0%, between 0.6% and 10.0%, between 0.8% and 10.0%, between 1.0% and 10.0%, between 1.2% and 10.0%, between 1.4% and 10.0%, between 1.6% and 10.0%, between 1.8% and 10.0%, between 2.0% and 10.0%, between 2.2% and 10.0%, between 2.4% and 10.0%, between 2.6% and 10.0%, between 2.8% and 10.0%, between 3.0% and 10.0%, between 3.2% and 10.0%, between 3.4% and 10.0%, between 3.6% and 10.0%, between 3.8% and 10.0%, between 4.0% and 10.0%, between 4.5% and 10.0%, between 5.0% and 10.0%, between 5.5% and 10.0%, between 6.0% and 10.0%, between 6.5% and 10.0%, between 7.0% and 10.0%, between 7.5% and 10.0%, between 8.0% and 10.0%, between 8.5% and 10.0%, between 9.0% and 10.0%, or between 9.5% and 10.0%, greater than that of a control corn plant grown under comparable conditions.

According to an aspect of the present disclosure, a modified, transgenic, or genome edited/mutated corn plant exhibits an ear diameter that is between 0.2% and 9.5%, between 0.2% and 9.0%, between 0.2% and 8.5%, between 0.2% and 8.0%, between 0.2% and 7.5%, between 0.2% and 7.0%, between 0.2% and 6.5%, between 0.2% and 6.0%, between 0.2% and 5.5%, between 0.2% and 5.0%, between 0.2% and 4.5%, between 0.2% and 4.0%, between 0.2% and 3.8%, between 0.2% and 3.6%, between 0.2% and 3.4%, between 0.2% and 3.2%, between 0.2% and 3.0%, between 0.2% and 2.8%, between 0.2% and 2.6%, between 0.2% and 2.4%, between 0.2% and 2.2%, between 0.2% and 2.0%, between 0.2% and 1.8%, between 0.2% and 1.6%, between 0.2% and 1.4%, between 0.2% and 1.2%, between 0.2% and 1.0%, between 0.2% and 0.8%, between 0.2% and 0.6%, or between 0.2% and 0.4%, greater than that of a control corn plant grown under comparable conditions.

According to an aspect of the present disclosure, a modified, transgenic, or genome edited/mutated corn plant exhibits an ear diameter that is between 0.4% and 9.5%, between 0.6% and 9.0%, between 0.8% and 8.5%, between 1.0% and 8.0%, between 1.2% and 7.5%, between 1.4% and 7.0%, between 1.6% and 6.5%, between 1.8% and 6.0%, between 2.0% and 5.5%, between 2.2% and 5.0%, between 2.4% and 4.5%, between 2.6% and 4.0%, between 2.8% and 3.8%, between 3.0% and 3.6%, or between 3.2% and 3.4%, greater than that of a control corn plant grown under comparable conditions.

According to an aspect of the present disclosure, a modified, transgenic, or genome edited/mutated corn plant exhibits an ear diameter that is between 0.2% and 0.6%, between 0.6% and 1.0%, between 1.0% and 1.4%, between 1.4% and 1.8%, between 1.8% and 2.2%, between 2.2% and 2.6%, between 2.6% and 3.0%, between 3.0% and 3.5%, between 3.5% and 4.0%, between 4.0% and 4.5%, between 4.5% and 5.0%, between 5.0% and 5.5%, between 5.5% and 6.0%, between 6.0% and 6.5%, between 6.5% and 7.0%, between 7.0% and 7.5%, between 7.5% and 8.0%, between 8.0% and 8.5%, between 8.5% and 9.0%, between 9.0% and 9.5%, or between 9.5% and 10.0%, greater than that of a control corn plant grown under comparable conditions.

In an aspect, a modified, transgenic, or genome edited/mutated corn plant exhibits increased ear length relative to a control corn plant grown under comparable conditions.

According to an aspect of the present disclosure, a modified, transgenic, or genome edited/mutated corn plant exhibits an increase in ear length by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear length that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a corn plant grown under comparable conditions.

According to an aspect of the present disclosure, a modified, transgenic, or genome edited/mutated corn plant exhibits an ear length that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits an ear length that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits an ear length that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

In an aspect, a modified, transgenic, or genome edited/mutated corn plant exhibits decreased ear tip void relative to a control corn plant grown under comparable conditions.

According to an aspect of the present disclosure, a modified, transgenic, or genome edited/mutated corn plant exhibits an decrease in ear tip void by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits an ear tip void that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% less than that of a control corn plant grown under comparable conditions.

According to an aspect of the present disclosure, a modified, transgenic, or genome edited/mutated corn plant exhibits an ear tip void that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% less than that of a control corn plant grown under comparable conditions.

According to an aspect of the present disclosure, a modified, transgenic, or genome edited/mutated corn plant exhibits an ear tip void that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% less than that of a control corn plant grown under comparable conditions.

According to an aspect of the present disclosure, a modified, transgenic, or genome edited/mutated corn plant exhibits an ear tip void that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% less than that of a control corn plant grown under comparable conditions.

In an aspect, a modified, transgenic, or genome edited/mutated corn plant exhibits an increased number of kernels per ear relative to a control corn plant grown under comparable conditions.

According to an aspect of the present disclosure, a modified, transgenic, or genome edited/mutated corn plant exhibits an increase in number of kernels per ear by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits kernels per ear that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits kernels per ear that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits kernels per ear that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits kernels per ear that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

In an aspect, a modified, transgenic, or genome edited/mutated corn plant exhibits increased single kernel weight relative to a control corn plant grown under comparable conditions.

According to an aspect of the present disclosure, a modified, transgenic, or genome edited/mutated corn plant exhibits an increase in single kernel weight by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits a single kernel weight that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 25% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits a single kernel weight that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 25%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits a single kernel weight that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits a single kernel weight that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

According to an aspect of the present disclosure, a modified, transgenic, or genome edited/mutated corn plant exhibits a single kernel weight that is between 1% and 2%, between 2% and 3%, between 3% and 4%, between 4% and 5%, between 5% and 6%, between 6% and 7%, between 7% and 8%, between 8% and 9%, or between 9% and 10% greater than that of a control corn plant grown under comparable conditions.

In an aspect, a modified, transgenic, or genome edited/mutated corn plant exhibits increased ear fresh weight relative to a control corn plant.

According to an aspect of the present disclosure, a modified, transgenic, or genome edited/mutated corn plant exhibits an increased ear fresh weight by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% relative to a control corn plant grown under comparable conditions.

According to an aspect of the present disclosure, a modified, transgenic, or genome edited/mutated corn plant exhibits an ear fresh weight that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 21% and 100%, between 22% and 100%, between 23% and 100%, between 24% and 100%, between 25% and 100%, between 26% and 100%, between 27% and 100%, between 28% and 100%, between 29% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits an ear fresh weight that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 29%, between 1% and 28%, between 1% and 27%, between 1% and 26%, between 1% and 25%, between 1% and 24%, between 1% and 23%, between 1% and 22%, between 1% and 21%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits an ear fresh weight that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits an ear fresh weight that is between 1% and 5%, between 5% and 10%, between 10% and 15%, between 15% and 20%, between 20% and 25%, between 25% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

According to an aspect of the present disclosure, a modified, transgenic, or genome edited/mutated corn plant exhibits an ear fresh weight that is between 1% and 2%, between 2% and 3%, between 3% and 4%, between 4% and 5%, between 5% and 6%, between 6% and 7%, between 7% and 8%, between 8% and 9%, between 9% and 10%, between 10% and 11%, between 11% and 12%, between 12% and 13%, between 13% and 14%, between 14% and 15%, between 15% and 16%, between 16% and 17%, between 17% and 18%, between 18% and 19%, between 19% and 20%, between 20% and 21%, between 21% and 22%, between 22% and 23%, between 23% and 24%, between 24% and 25%, between 25% and 26%, between 26% and 27%, between 27% and 28%, between 28% and 29%, between 29% and 30%, greater than that of a control corn plant grown under comparable conditions.

In an aspect, a modified, transgenic, or genome edited/mutated corn plant exhibits an increased yield relative to a control corn plant.

According to an aspect of the present disclosure, a modified, transgenic, or genome edited/mutated corn plant exhibits an increased yield by at least 1%, at least 3%, at least 5%, at least 7%, at least 9%, at least 11%, at least 13%, at least 15%, at least 17%, at least 19%, at least 21%, at least 23%, at least 25%, at least 27%, at least 29%, at least 31%, at least 33%, at least 35%, at least 37%, at least 39%, at least 41%, at least 43%, at least 45%, at least 47%, at least 49%, at least 50%, at least 55%, at least 60%, at least 65%, at least 70%, at least 75%, at least 80%, at least 85%, at least 90%, at least 95%, at least 100%, relative to a control corn plant grown under comparable conditions.

According to an aspect of the present disclosure, a modified, transgenic, or genome edited/mutated corn plant exhibits a yield that is between 1% and 100%, between 3% and 100%, between 5% and 100%, between 7% and 100%, between 9% and 100%, between 11% and 100%, between 13% and 100%, between 15% and 100%, between 17% and 100%, between 19% and 100%, between 21% and 100%, between 23% and 100%, between 25% and 100%, between 27% and 100%, between 29% and 100%, between 31% and 100%, between 33% and 100%, between 35% and 100%, between 37% and 100%, between 39% and 100%, between 41% and 100%, between 43% and 100%, between 45% and 100%, between 47% and 100%, between 49% and 100%, between 50% and 100%, between 55% and 100%, between 60% and 100%, between 65% and 100%, between 70% and 100%, between 75% and 100%, between 80% and 100%, between 85% and 100%, between 90% and 100%, between 95% and 100%, greater than that of a control corn plant grown under comparable conditions.

According to an aspect of the present disclosure, a modified, transgenic, or genome edited/mutated corn plant exhibits a yield that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 49%, between 1% and 47%, between 1% and 45%, between 1% and 43%, between 1% and 41%, between 1% and 39%, between 1% and 37%, between 1% and 35%, between 1% and 33%, between 1% and 31%, between 1% and 29%, between 1% and 27%, between 1% and 25%, between 1% and 23%, between 1% and 21%, between 1% and 19%, between 1% and 17%, between 1% and 15%, between 1% and 13%, between 1% and 11%, between 1% and 9%, between 1% and 7%, between 1% and 5%, or between 1% and 3%, greater than that of a control corn plant grown under comparable conditions.

According to an aspect of the present disclosure, a modified, transgenic, or genome edited/mutated corn plant exhibits a yield that is between 3% and 95%, between 5% and 90%, between 7% and 85%, between 9% and 80%, between 11% and 75%, between 13% and 70%, between 15% and 65%, between 17% and 60%, between 19% and 55%, between 21% and 50%, between 23% and 49%, between 25% and 47%, between 27% and 45%, between 29% and 43%, between 31% and 41%, between 33% and 39%, or between 35% and 37%, greater than that of a control corn plant grown under comparable conditions.

According to an aspect of the present disclosure, a modified, transgenic, or genome edited/mutated corn plant exhibits a yield that is between 1% and 7%, between 7% and 13%, between 13% and 19%, between 19% and 25%, between 25% and 31%, between 31% and 37%, between 37% and 43%, between 43% and 49%, between 49% and 55%, between 55% and 60%, between 60% and 65%, between 65% and 70%, between 70% and 75%, between 75% and 80%, between 80% and 85%, between 85% and 90%, between 90% and 95%, or between 95% and 100%, greater than that of a control corn plant grown under comparable conditions.

In an aspect, modified, transgenic, or genome edited/mutated corn plants exhibit increased kernels per field area relative to control corn plants.

According to an aspect of the present disclosure, modified, transgenic, or genome edited/mutated corn plants exhibit increased kernels per field area by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to control corn plants.

According to an aspect of the present disclosure, modified, transgenic, or genome edited/mutated corn plants exhibit kernels per field area that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 21% and 100%, between 22% and 100%, between 23% and 100%, between 24% and 100%, between 25% and 100%, between 26% and 100%, between 27% and 100%, between 28% and 100%, between 29% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of control corn plants grown under comparable conditions.

According to an aspect of the present disclosure, modified, transgenic, or genome edited/mutated corn plants exhibit kernels per field area that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 29%, between 1% and 28%, between 1% and 27%, between 1% and 26%, between 1% and 25%, between 1% and 24%, between 1% and 23%, between 1% and 22%, between 1% and 21%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of control corn plants grown under comparable conditions.

According to an aspect of the present disclosure, modified, transgenic, or genome edited/mutated corn plants exhibit kernels per field area that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of control corn plants grown under comparable conditions.

According to an aspect of the present disclosure, modified, transgenic, or genome edited/mutated corn plants exhibit kernels per field area that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of control corn plants grown under comparable conditions.

According to an aspect of the present disclosure, modified, transgenic, or genome edited/mutated corn plants exhibit kernels per field area that is between 1% and 3%, between 3% and 5%, between 5% and 7%, between 7% and 9%, between 9% and 11%, between 11% and 13%, between 13% and 15%, between 15% and 17%, between 17% and 19%, between 19% and 21%, between 21% and 23%, between 23% and 25%, between 25% and 27%, between 27% and 29%, or between 29% and 30% greater than that of control corn plants grown under comparable conditions.

In an aspect, a modified, transgenic, or genome edited/mutated corn plant exhibits increased number of florets relative to a control corn plant.

According to an aspect of the present disclosure, a modified, transgenic, or genome edited/mutated corn plant exhibits increased number of florets by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, at least 30%, at least 35%, at least 40%, at least 45%, at least 50%, at least 55%, at least 60%, at least 65%, at least 70%, at least 75%, at least 80%, at least 85%, at least 90%, at least 95%, at least 100%, relative to a control corn plant.

According to an aspect of the present disclosure, a modified, transgenic, or genome edited/mutated corn plant exhibits a number of florets that is between 1% and 100%, between 2% and 100%, between 3% and 100%, between 4% and 100%, between 5% and 100%, between 6% and 100%, between 7% and 100%, between 8% and 100%, between 9% and 100%, between 10% and 100%, between 11% and 100%, between 12% and 100%, between 13% and 100%, between 14% and 100%, between 15% and 100%, between 16% and 100%, between 17% and 100%, between 18% and 100%, between 19% and 100%, between 20% and 100%, between 21% and 100%, between 22% and 100%, between 23% and 100%, between 24% and 100%, between 25% and 100%, between 26% and 100%, between 27% and 100%, between 28% and 100%, between 29% and 100%, between 30% and 100%, between 35% and 100%, between 40% and 100%, between 45% and 100%, between 50% and 100%, between 55% and 100%, between 60% and 100%, between 65% and 100%, between 70% and 100%, between 75% and 100%, between 80% and 100%, between 85% and 100%, between 90% and 100%, or between 95% and 100% greater than that of a control corn plant grown under comparable conditions.

According to an aspect of the present disclosure, a modified, transgenic, or genome edited/mutated corn plant exhibits a number of florets that is between 1% and 95%, between 1% and 90%, between 1% and 85%, between 1% and 80%, between 1% and 75%, between 1% and 70%, between 1% and 65%, between 1% and 60%, between 1% and 55%, between 1% and 50%, between 1% and 45%, between 1% and 40%, between 1% and 35%, between 1% and 30%, between 1% and 29%, between 1% and 28%, between 1% and 27%, between 1% and 26%, between 1% and 25%, between 1% and 24%, between 1% and 23%, between 1% and 22%, between 1% and 21%, between 1% and 20%, between 1% and 19%, between 1% and 18%, between 1% and 17%, between 1% and 16%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, or between 1% and 2% greater than that of a control corn plant grown under comparable conditions.

According to an aspect of the present disclosure, a modified, transgenic, or genome edited/mutated corn plant exhibits a number of florets that is between 2% and 90%, between 3% and 85%, between 4% and 80%, between 5% and 75%, between 6% and 70%, between 7% and 65%, between 8% and 60%, between 9% and 55%, between 10% and 50%, between 11% and 45%, between 12% and 40%, between 13% and 35%, between 14% and 30%, or between 15% and 25% greater than that of a control corn plant grown under comparable conditions.

According to an aspect of the present disclosure, a modified, transgenic, or genome edited/mutated corn plant exhibits a number of florets that is between 1% and 5%, between 5% and 10%, between 10% and 20%, between 20% and 30%, between 30% and 40%, between 40% and 50%, between 50% and 60%, between 60% and 70%, between 70% and 80%, between 80% and 90%, or between 90% and 100% greater than that of a control corn plant grown under comparable conditions.

According to an aspect of the present disclosure, a modified, transgenic, or genome edited/mutated corn plant exhibits a number of florets that is between 1% and 3%, between 3% and 5%, between 5% and 7%, between 7% and 9%, between 9% and 11%, between 11% and 13%, between 13% and 15%, between 15% and 17%, between 17% and 19%, between 19% and 21%, between 21% and 23%, between 23% and 25%, between 25% and 27%, between 27% and 29%, or between 29% and 30% greater than that of a control corn plant grown under comparable conditions.

A modified, transgenic, or genome edited/mutated corn plant disclosed in the present disclosure can display a positive trait interaction in which a trait, such as a positive or negative trait, attributable to a transgene (or mutation or edit) can be enhanced, out-performed, neutralized, offset or mitigated due to the presence of a second transgene (or mutation or edit). Such a transgenic and/or genome edited/mutated corn plant can exhibit improved ear traits as compared to a control corn plant comprising only one transgene (or mutation or edit). For example, GA20Ox_SUP/PpCOL stack plants may have enhanced traits and/or positive trait interactions relative to PpCOL single and/or GA20Ox_SUP single plants, in terms of increased ear area, number of florets per ear, single kernel weight, ear fresh weight, and/or yield.

In another aspect, a modified, transgenic, or genome edited/mutated corn plant of the present disclosure exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased seed number, increased seed weight, increased prolificacy, and a combination thereof, relative to a control corn plant.

In yet another aspect, a modified, transgenic, or genome edited/mutated corn plant of the present disclosure does not have any significant off-types in at least one female organ or ear.

According to an aspect of the present disclosure, a modified, transgenic, or genome edited/mutated corn plant has no or reduced adverse effect over a trait or phenotype selected from the group consisting of senescence, delayed flowering, fungal infection, and a combination thereof, relative to a control corn plant.

Short stature or semi-dwarf corn plants can also have one or more additional traits, including increased stem diameter, reduced green snap, deeper roots, increased leaf area, earlier canopy closure, higher stomatal conductance, lower ear height, increased foliar water content, improved drought tolerance, increased nitrogen use efficiency, increased water use efficiency, reduced anthocyanin content and area in leaves under normal or nitrogen or water limiting stress conditions, increased ear weight, increased kernel number, increased kernel weight, increased yield, and/or increased harvest index.

According to an aspect of the present disclosure, a modified, transgenic, or genome edited/mutated corn plant provided herein comprises a harvest index of at least 0.57, at least 0.58, at least 0.59, at least 0.60, at least 0.61, at least 0.62, at least 0.63, at least 0.64, or at least 0.65. According to another aspect of the present disclosure a modified, transgenic, or genome edited/mutated corn plant provided herein comprises a harvest index of between 0.57 and 0.65, between 0.57 and 0.64, between 0.57 and 0.63, between 0.57 and 0.62, between 0.57 and 0.61, between 0.57 and 0.60, between 0.57 and 0.59, between 0.57 and 0.58, between 0.58 and 0.65, between 0.59 and 0.65, or between 0.60 and 0.65. According to yet another aspect of the present disclosure, a modified, transgenic, or genome edited/mutated corn plant provided herein comprises a harvest index that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 20%, at least 25%, at least 30%, at least 35%, at least 40%, at least 45%, or at least 50% greater as compared to an unmodified control plant. According to still another aspect of the present disclosure, a modified, transgenic, or genome edited/mutated corn plant provided herein comprises a harvest index that is between 1% and 45%, between 1% and 40%, between 1% and 35%, between 1% and 30%, between 1% and 25%, between 1% and 20%, between 1% and 15%, between 1% and 14%, between 1% and 13%, between 1% and 12%, between 1% and 11%, between 1% and 10%, between 1% and 9%, between 1% and 8%, between 1% and 7%, between 1% and 6%, between 1% and 5%, between 1% and 4%, between 1% and 3%, between 1% and 2%, between 5% and 15%, between 5% and 20%, between 5% and 30%, or between 5% and 40% greater as compared to a control plant.

According to another aspect of the present disclosure, methods are provided for planting a modified or transgenic plant(s) provided herein at a normal/standard or high density in field. According to some aspects, the yield of a crop plant per acre (or per land area) can be increased by planting a modified or transgenic plant(s) of the present disclosure at a higher density in the field. As described herein, modified or transgenic plants expressing a transcribable DNA sequence that encodes a non-coding RNA molecule targeting one or more endogenous GA20 and/or GA3 oxidase gene for suppression and a transgene encoding one or more CO or COL polypeptide, can have reduced plant height, shorter internode(s), increased stalk/stem diameter, and/or increased lodging resistance. Modified or transgenic plants described herein can tolerate high density planting conditions since an increase in stem diameter can resist lodging and the shorter plant height can allow for increased light penetration to the lower leaves under high density planting conditions. Thus, modified or transgenic plants provided herein can be planted at a higher density to increase the yield per acre (or land area) in the field. For row crops, higher density can be achieved by planting a greater number of seeds/plants per row length and/or by decreasing the spacing between rows. In an aspect, the row spacing for high density planting of the modified, transgenic, or genome edited/mutated corn plants is less than or equal to 40 inches. In an aspect, the row spacing for high density planting of the modified, transgenic, or genome edited/mutated corn plants is less than or equal to 30 inches. In another aspect, the row spacing for high density planting of the modified, transgenic, or genome edited/mutated corn plants is less than or equal to 20 inches.

According to an aspect, seeds of a modified or transgenic crop plants can be planted at a density in the field (plants per land/field area) that is at least 5%, 10%, 15%, 20%, 25%, 50%, 75%, 100%, 125%, 150%, 175%, 200%, 225%, or 250% higher than the normal planting density for that crop plant according to standard agronomic practices. A modified or transgenic crop plant can be planted at a density in the field of at least 38,000 plants per acre, at least 40,000 plants per acre, at least 42,000 plants per acre, at least 44,000 plants per acre, at least 45,000 plants per acre, at least 46,000 plants per acre, at least 48,000 plants per acre, 50,000 plants per acre, at least 52,000 plants per acre, at least 54,000 per acre, or at least 56,000 plants per acre.

As an example, seeds of corn plants can be planted at a higher density, such as in a range from about 38,000 plants per acre to about 60,000 plants per acre, or about 40,000 plants per acre to about 58,000 plants per acre, or about 42,000 plants per acre to about 58,000 plants per acre, or about 40,000 plants per acre to about 45,000 plants per acre, or about 45,000 plants per acre to about 50,000 plants per acre, or about 50,000 plants per acre to about 58,000 plants per acre, or about 52,000 plants per acre to about 56,000 plants per acre, or about 38,000 plants per acre, about 42,000 plant per acre, about 46,000 plant per acre, or about 48,000 plants per acre, about 50,000 plants per acre, or about 52,000 plants per acre, or about 54,000 plant per acre, as opposed to a standard density range, such as about 18,000 plants per acre to about 38,000 plants per acre.

Exemplary Embodiments

The following are exemplary embodiments of the present specification.

1. A modified corn plant or a plant part thereof comprising 1) a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, and 2) a second recombinant expression cassette comprising a DNA sequence encoding a CONSTANS (CO) or CONSTANS-like (COL) polypeptide.

2. The modified corn plant of embodiment 1, wherein the first and second recombinant expression cassettes are stably integrated into the genome of the corn plant or plant part thereof.

3. The modified corn plant or plant part thereof of embodiment 1, wherein the modified corn plant is semi-dwarf and has one or more improved ear traits, relative to a control corn plant that does not have the first or second recombinant expression cassettes.

4. The modified corn plant or plant part thereof of embodiment 1, 2, or 3, wherein the transcribable DNA sequence encodes a non-coding RNA for suppression of a GA3 oxidase gene.

5. The modified corn plant or plant part thereof of embodiment 4, wherein the transcribable DNA sequence encodes a non-coding RNA for suppression of a GA3 oxidase_1 gene, a GA3 oxidase_2 gene, or both.

6. The modified corn plant or plant part thereof of embodiment 5, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

7. The modified corn plant or plant part thereof of embodiment 5, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

8. The modified corn plant or plant part thereof of embodiment 1, 2, or 3, wherein the transcribable DNA sequence encodes a non-coding RNA for suppression of a GA20 oxidase gene.

9. The modified corn plant or plant part thereof of embodiment 8, wherein the transcribable DNA sequence encodes a non-coding RNA for suppression of a GA20 oxidase_3 gene, a GA20 oxidase_4 gene, a GA20 oxidase_5 gene, or a combination thereof.

10. The modified corn plant or plant part thereof of embodiment 8, wherein the transcribable DNA sequence encodes a non-coding RNA for suppression of a GA20 oxidase_3 gene, a GA20 oxidase_5 gene, or both.

11. The modified corn plant or plant part thereof of embodiment 10, wherein the transcribable DNA sequence comprises a sequence that is at least 60% identical or complementary to at least 15 consecutive nucleotides of SEQ ID NO: 39, 53, or 55.

12. The modified corn plant or plant part thereof of embodiment 10, wherein the transcribable DNA sequence encodes a sequence that is at least 60% identical or complementary to at least 15 consecutive nucleotides of SEQ ID NO: 40, 54, or 56.

13. The modified corn plant or plant part thereof of any one of embodiments 4 to 10, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, 15, 30, or 33.

14. The modified corn plant or plant part thereof of any one of embodiments 4 to 10, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, 14, 28, 29, 31, or 32.

15. The modified corn plant or plant part thereof of embodiment 1, 2, or 3, wherein the second recombinant expression cassette comprises a DNA sequence encoding a CO or COL polypeptide.

16. The modified corn plant or plant part thereof of embodiment 15, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

17. The modified corn plant or plant part thereof of embodiment 15, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

18. The modified corn plant or plant part thereof of any one of embodiments 1 to 3, wherein the CO or COL polypeptide comprises a *Physcomitrella patens* CONSTANS-like 1 (PpCOL1) polypeptide.

19. The modified corn plant or plant part thereof of any one of embodiments 1 to 17, wherein the DNA sequence comprised in the second recombinant expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

20. The modified corn plant or plant part thereof of any one of embodiments 1 to 17, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168

21. The modified corn plant or plant part thereof of embodiment 1 or 3, wherein the expression level of an endogenous GA20 oxidase or GA3 oxidase gene is reduced or eliminated in the modified corn plant or plant part thereof.

22. The modified corn plant or plant part thereof of embodiment 1 or 3, wherein the transcribable DNA sequence is operably linked to a heterologous plant-expressible promoter.

23. The modified corn plant or plant part thereof of embodiment 22, wherein the heterologous plant-expressible promoter is a vascular promoter.

24. The modified corn plant or plant part thereof of embodiment 23, wherein the vascular promoter is selected from the group consisting of a sucrose synthase promoter, a sucrose transporter promoter, a Sh1 promoter, *Commelina* yellow mottle virus (CoYMV) promoter, a wheat dwarf geminivirus (WDV) large intergenic region (LIR) promoter, a maize streak geminivirus (MSV) coat polypeptide (CP) promoter, a rice yellow stripe 1 (YS1)-like promoter, a rice yellow stripe 2 (OsYSL2) promoter, and a combination thereof.

25. The modified corn plant or plant part thereof of embodiment 24, wherein the vascular promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 67, SEQ ID NO: 68, SEQ ID NO: 69, SEQ ID NO: 70 or SEQ ID NO: 71, or a functional portion thereof.

26. The modified corn plant or plant part thereof of embodiment 22, wherein the heterologous plant-expressible promoter is a rice tungro bacilliform virus (RTBV) promoter.

27. The modified corn plant or plant part thereof of embodiment 26, wherein RTBV promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 65 or SEQ ID NO: 66, or a functional portion thereof.

28. The modified corn plant or plant part thereof of embodiment 22, wherein the heterologous plant-expressible promoter is a leaf promoter.

29. The modified corn plant or plant part thereof of embodiment 28, wherein the leaf promoter is selected from the group consisting of a RuBisCO promoter, a pyruvate phosphate dikinase (PPDK) promoter, a fructose 1-6 bisphosphate aldolase (FDA) promoter, a Nadh-Gogat promoter, a chlorophyll a/b binding polypeptide gene promoter, a phosphoenolpyruvate carboxylase (PEPC) promoter, a Myb gene promoter, and a combination thereof.

30. The modified corn plant or plant part thereof of embodiment 29, wherein the leaf promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 72, SEQ ID NO: 73 or SEQ ID NO: 74, or a functional portion thereof.

31. The modified corn plant or plant part thereof of embodiment 22, wherein the heterologous plant-expressible promoter is a constitutive promoter.

32. The modified corn plant or plant part thereof of embodiment 31, wherein the constitutive promoter is selected from the group consisting of an actin promoter, a Cauliflower mosaic virus (CaMV) 35S or 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

33. The modified corn plant or plant part thereof of embodiment 32, wherein the constitutive promoter comprises a DNA sequence that is at least 80%, at least 85%, at least 90%, at least 95%, at least 96%, at least 97%, at least 98%, at least 99%, at least 99.5% or 100% identical to one or more of SEQ ID NOs: 75, SEQ ID NO: 76, SEQ ID NO: 77, SEQ ID NO: 78, SEQ ID NO: 79, SEQ ID NO: 80, SEQ ID NO: 81, SEQ ID NO: 82 or SEQ ID NO: 83, or a functional portion thereof 34. The modified corn plant or plant part thereof of embodiment 1 or 3, wherein the non-coding RNA is a precursor miRNA or siRNA capable of being processed or cleaved to form a mature miRNA or siRNA.

35. The modified corn plant or plant part thereof of embodiment 1 or 3, wherein the DNA sequence comprised in the second recombinant expression cassette is operably linked to a heterologous plant-expressible promoter.

36. The modified corn plant or plant part thereof of embodiment 35, wherein the heterologous plant-expressible promoter is a constitutive promoter.

37. The modified corn plant or plant part thereof of embodiment 36, wherein the constitutive promoter is selected from the group consisting of an actin promoter, a Cauliflower mosaic virus (CaMV) 35S or 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

38. The modified corn plant or plant part thereof of embodiment 35, wherein the heterologous plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 172 or a functional portion thereof.

39. The modified corn plant or plant part thereof of any one of embodiments 1 to 38 wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

40. The modified corn plant or plant part thereof of any one of embodiments 1 to 39, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

41. The modified corn plant or plant part thereof of any one of embodiments 1 to 40, wherein the modified corn plant exhibits improved lodging resistance, reduced green snap, or both, relative to a control corn plant.

42. The modified corn plant or plant part thereof of any one of embodiments 1 to 41, wherein the modified corn plant exhibits increased ear area relative to a control corn plant.

43. The modified corn plant or plant part thereof of any one of embodiments 1 to 42, wherein the modified corn plant exhibits an increase in ear area by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to a control corn plant.

44. The modified corn plant or plant part thereof of any one of embodiments 1 to 43, wherein the modified corn plant exhibits increased single kernel weight relative to a control corn plant.

45. The modified corn plant or plant part thereof of any one of embodiments 1 to 44, wherein the modified corn plant exhibits an increase in singe kernel weight by at least at least 1%, at least 2%, at least 3%, at least 4%, at least 5%, at least 6%, at least 7%, at least 8%, at least 9%, or at least 10%, relative to a control corn plant.

46. The modified corn plant or plant part thereof of any one of embodiments 1 to 45, wherein the modified corn plant exhibits increased ear fresh weight relative to a control corn plant.

47. The modified corn plant or plant part thereof of any one of embodiments 1 to 46, wherein the modified corn plant exhibits increased ear fresh weight by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, or at least 20%, relative to a control corn plant.

48. The modified corn plant or plant part thereof of any one of embodiments 1 to 47, wherein the modified corn plant exhibits increased number of florets relative to a control corn plant.

49. The modified corn plant or plant part thereof of any one of embodiments 1 to 48, wherein the modified corn plant exhibits increased number of florets by at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, or at least 30%, relative to a control corn plant.

50. The modified corn plant or plant part thereof of any one of embodiments 1 to 49, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to the control corn plant.

51. The modified corn plant or plant part thereof of any one of embodiments 1 to 50, wherein the modified corn plant does not have any significant off-types in at least one female organ or ear.

52. A seed of the modified corn plant of any one of embodiments 1 to 51, wherein the seed comprises the first and second recombinant expression cassettes.

53. The seed of embodiment 52, wherein a progeny plant grown from the seed is semi-dwarf and has one or more improved ear traits, relative to a control corn plant that does not comprise the first or second recombinant expression cassette.

54. A commodity or commodity product produced from the seed of embodiment 52, comprising the first and second DNA sequence recombinant expression cassettes.

55. A method comprising planting the seed of embodiment 52 in a growth medium or soil.

56. The method of embodiment 55, further comprising planting a plurality of the seeds with a row spacing of less than or equal to 40 inches.

57. The method of embodiment 55, further comprising planting a plurality of the seeds with a row spacing of less than or equal to 30 inches.

58. The method of embodiment 57, wherein the row spacing is less than or equal to 20 inches.

59. The method of embodiment 55, further comprising growing a corn plant from the seed.

60. The method of embodiment 59, further comprising harvesting a seed from the corn plant.

61. The method of any one of embodiments 57 to 60, wherein the seed is planted at a density selected from the group consisting of at least 38,000 plants per acre, at least 40,000 plants per acre, at least 42,000 plants per acre, at least 44,000 plants per acre, at least 45,000 plants per acre, at least 46,000 plants per acre, at least 48,000 plants per acre, 50,000 plants per acre, at least 52,000 plants per acre, at least 54,000 per acre, and at least 56,000 plants per acre.

62. A plurality of modified corn plants in a field, each modified corn plant comprising
  a. a first recombinant expression cassette comprising a transcribable DNA sequence encoding a non-coding RNA for suppression of one or more gibberellic acid 20 (GA20) oxidase genes and/or one or more gibberellic acid 3 (GA3) oxidase genes, and
  b. a second recombinant expression cassette comprising a DNA sequence encoding a CO or COL polypeptide.

63. The plurality of modified corn plants of embodiment 62, wherein the modified corn plants have increased yield relative to control corn plants.

64. The plurality of modified corn plants of embodiment 62 or 63, wherein the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

65. A method for producing a modified corn plant, the method comprising:
  a. introducing into a corn cell a first recombinant expression cassette comprising a DNA sequence encoding a CO or COL polypeptide, wherein the corn cell comprises a second recombinant expression cassette comprising a transcribable DNA sequence encoding a non-coding RNA for suppression of one or more GA3 oxidase genes and/or one or more GA20 oxidase genes; and
  b. regenerating or developing a modified corn plant from the corn cell, wherein the modified corn plant comprises the first and second recombinant expression cassettes.

66. The method of embodiment 65, wherein the introducing is via site-directed integration using a site-specific nuclease.

67. The method of embodiment 66, wherein the site-specific nuclease is selected from the group consisting of a RNA-guided endonuclease, a meganuclease, a zinc-finger nuclease (ZFN), a TALE-endonuclease (TALEN), a recombinase, and a transposase.

68. The method of embodiment 65, wherein the introducing is via *Agrobacterium*-mediated transformation.

69. The method of embodiment 65, wherein the introducing is via particle bombardment.

70. The method of any one of embodiments 65 to 69, wherein the transcribable DNA sequence encodes a non-coding RNA for suppression of a GA3 oxidase_1 gene, a GA3 oxidase_2 gene, or both.

71. The method of embodiment 70, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

72. The method of embodiment 70, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

73. The method of any one of embodiments 65 to 69, wherein the transcribable DNA sequence encodes a non-coding RNA for suppression of a GA20 oxidase gene.

74. The method of embodiment 73, wherein the transcribable DNA sequence encodes a non-coding RNA for suppression of a GA20 oxidase_3 gene, a GA20 oxidase_4 gene, a GA20 oxidase_5 gene, or a combination thereof.

75. The method of embodiment 74, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, 15, 30, or 33.

76. The method of embodiment 74, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, 14, 28, 29, 31, or 32.

77. The method of any one of embodiments 65 to 76, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

78. The method of any one of embodiments 65 to 76, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

79. The method of any one of embodiments 65 to 76, wherein the CO or COL polypeptide comprises a *Physcomitrella patens* CONSTANS-like 1 (PpCOL1) polypeptide.

80. The method of any one of embodiments 65 to 76, wherein the DNA sequence comprised in the first recombinant expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

81. The method of any one of embodiments 65 to 76, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

82. The modified corn plant of embodiment 65, wherein the first and second recombinant expression cassettes are stably integrated into the genome of the corn cell.

83. The method of embodiment 65, further comprising selecting a modified corn plant having a desired trait.

84. The method of embodiment 83, wherein the selected modified corn plant is semi-dwarf and has one or more improved ear traits, relative to a control corn plant not having the first or the second recombinant expression cassettes.

85. The method of embodiment 83 or 84, wherein the selecting a modified corn plant having a desired trait comprises the use of one or more molecular techniques.

86. The method of embodiment 85, wherein the one or more molecular techniques are selected from the group consisting of Southern analysis, polymerase chain reaction (PCR) amplification, Northern blots, RNase protection, primer extension, reverse transcription PCR (RT-PCR), Sanger sequencing, Next Generation sequencing technologies, enzymatic assays, protein gel electrophoresis, Western blots, immunoprecipitation, enzyme-linked immunoassays, in situ hybridization, enzyme staining, immunostaining, marker genotyping, and a combination thereof.

87. The method of any one of embodiments 65 to 86, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

88. The method of any one of embodiments 65 to 87, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

89. The method of any one of embodiments 65 to 88, wherein the modified corn plant exhibit an ear trait selected from the group consisting of increased ear area, increased single kernel weight, increased ear fresh weight, increased number of florets, and a combination thereof, relative to a control corn plant.

90. The method of any one of embodiments 65 to 88, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

91. A method for producing a modified corn plant, the method comprising:
   a. introducing into a corn cell a first recombinant expression cassette comprising a transcribable DNA sequence encoding a non-coding RNA for suppression of one or more GA3 oxidase genes and/or GA20 oxidase genes, wherein the corn cell comprises a second recombinant expression cassette comprising a DNA sequence encoding a CO and/or COL polypeptide; and
   b. regenerating or developing a modified corn plant from the corn cell, wherein the modified corn plant comprises the first and second recombinant expression cassettes.

92. The method of embodiment 91, wherein the introducing is via site-directed integration using a site-specific nuclease.

93. The method of embodiment 92, wherein the site-specific nuclease is selected from the group consisting of a RNA-guided endonuclease, a meganuclease, a zinc-finger nuclease (ZFN), a TALE-endonuclease (TALEN), a recombinase, and a transposase.

94. The method of embodiment 91, wherein the introducing is via *Agrobacterium*-mediated transformation.

95. The method of embodiment 91, wherein the introducing is via particle bombardment.

96. The method of any one of embodiments 91 to 95, wherein the transcribable DNA sequence encodes a non-coding RNA for suppression of a GA3 oxidase_1 gene, a GA3 oxidase_2 gene, or both.

97. The method of embodiment 96, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

98. The method of embodiment 96, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

99. The method of any one of embodiments 91 to 95, wherein the transcribable DNA sequence encodes a non-coding RNA for suppression of a GA20 oxidase gene.

100. The method of embodiment 99, wherein the transcribable DNA sequence encodes a non-coding RNA for suppression of a GA20 oxidase_3 gene, a GA20 oxidase_4 gene, a GA20 oxidase_5 gene, or a combination thereof.

101. The method of embodiment 100, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, 15, 30, or 33.

102. The method of embodiment 100, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, 14, 28, 29, 31, or 32.

103. The method of any one of embodiments 91 to 102, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

104. The method of any one of embodiments 91 to 102, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

105. The method of any one of embodiments 91 to 102, wherein the CO or COL polypeptide comprises a *Physcomitrella patens* CONSTANS-like 1 (PpCOL1) polypeptide.

106. The method of any one of embodiments 91 to 102, wherein the DNA sequence comprised in the second recombinant expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

107. The method of any one of embodiments 91 to 102, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

108. The modified corn plant of embodiment 91, wherein the first and second recombinant expression cassettes are stably integrated into the genome of the corn cell.

109. The method of embodiment 91, further comprising selecting a modified corn plant having a desired trait.

110. The method of embodiment 109, wherein the selected modified corn plant is semi-dwarf and has one or more improved ear traits, relative to a control corn plant not having the first or the second recombinant expression cassette.

111. The method of embodiment 109 or 110, wherein the selecting a modified corn plant having a desired trait comprises the use of one or more molecular techniques.

112. The method of embodiment 111, wherein the one or more molecular techniques are selected from the group consisting of Southern analysis, PCR amplification, Northern blots, RNase protection, primer extension, RT-PCR, Sanger sequencing, Next Generation sequencing technologies, enzymatic assays, protein gel electrophoresis, Western blots, immunoprecipitation, enzyme-linked immunoassays, in situ hybridization, enzyme staining, immunostaining, marker genotyping, and a combination thereof.

113. The method of any one of embodiments 91 to 112, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

114. The method of any one of embodiments 91 to 113, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

115. The method of any one of embodiments 91 to 114, wherein the modified corn plant exhibit an ear trait selected from the group consisting of increased ear area, increased single kernel weight, increased ear fresh weight, increased number of florets, and a combination thereof, relative to a control corn plant.

116. The method of any one of embodiments 91 to 115, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

117. A method for producing a modified corn plant, the method comprising
  a. introducing into a corn cell 1) a first recombinant expression cassette comprising a transcribable DNA sequence encoding a non-coding RNA for suppression of one or more GA3 oxidase genes and/or GA20 oxidase genes and 2) a second recombinant expression cassette comprising a DNA sequence encoding a CO or COL polypeptide; and
  b. regenerating or developing a modified corn plant from the corn cell, wherein the modified corn plant comprises the first and second recombinant expression cassettes.

118. A method for producing a modified corn plant, the method comprising
  a. introducing into a corn cell a first recombinant expression cassette comprising a transcribable DNA sequence encoding a non-coding RNA for suppression of one or more GA3 oxidase genes and/or GA20 oxidase genes;
  b. introducing into the corn cell of step (a) a second recombinant expression cassette comprising a DNA sequence encoding a CO or COL polypeptide to create a modified corn cell; and
  c. regenerating or developing a modified corn plant from the modified corn cell of step (b), wherein the modified corn plant comprises the first and second recombinant expression cassettes.

119. A method for producing a modified corn plant, the method comprising
  a. introducing into a corn cell a first recombinant expression cassette comprising a DNA sequence encoding a CO or COL polypeptide;
  b. introducing into the corn cell of step (a) a second recombinant expression cassette comprising a transcribable DNA sequence encoding a non-coding RNA for suppression of one or more GA3 oxidase genes and/or GA20 oxidase genes to create a modified corn cell; and
  c. regenerating or developing a modified corn plant from the modified corn cell of step (b), wherein the modified corn plant comprises the first and second recombinant expression cassettes.

120. A method for producing a modified corn plant, the method comprising:
  a. crossing a first modified corn plant with a second modified corn plant, wherein the expression or activity of one or more endogenous GA3 oxidase genes and/or GA20 oxidase genes is reduced in the first modified corn plant relative to a wildtype control, and wherein the second modified corn plant comprises a recombinant expression cassette comprising a DNA sequence encoding a CO or COL polypeptide; and
  b. producing a progeny corn plant comprising the recombinant expression cassette and has the reduced expression of the one or more endogenous GA3 oxidase genes and/or GA20 oxidase genes.

121. The method of embodiment 120, wherein the first and second modified corn plants are obtained via site-directed integration using a site-specific nuclease.

122. The method of embodiment 121, wherein the site-specific nuclease is selected from the group consisting of a RNA-guided endonuclease, a meganuclease, a zinc-finger nuclease (ZFN), a TALE-endonuclease (TALEN), a recombinase, and a transposase.

123. The method of embodiment 120, wherein the first and second modified corn plants are obtained via *Agrobacterium*-mediated transformation.

124. The method of embodiment 120, wherein the first and second modified corn plants are obtained via particle bombardment.

125. The method of embodiment 120 to 124, wherein the first modified corn plant and the progeny corn plant comprise a transcribable DNA sequence encoding a non-coding RNA for suppression of a GA3 oxidase_1 gene, a GA3 oxidase_2 gene, or both.

126. The method of embodiment 125, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

127. The method of embodiment 125, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

128. The method of any one of embodiments 120 to 124, wherein the transcribable DNA sequence encodes a non-coding RNA for suppression of a GA20 oxidase gene.

129. The method of embodiment 128, wherein the transcribable DNA sequence encodes a non-coding RNA for suppression of a GA20 oxidase_3 gene, a GA20 oxidase_4 gene, a GA20 oxidase_5 gene, or a combination thereof.

130. The method of embodiment 129, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, 15, 30, or 33.

131. The method of embodiment 129, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, 14, 28, 29, 31, or 32.

132. The method of any one of embodiments 120 to 131, wherein the second modified corn plant and the progeny corn plant comprise a recombinant expression cassette comprising a DNA sequence encoding a CO or COL polypeptide.

133. The method of embodiment 132, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

134. The method of embodiment 132, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

135. The method of any one of embodiments 120 to 131, wherein the CO or COL polypeptide comprises a *Physcomitrella patens* CONSTANS-like 1 (PpCOL1) polypeptide.

136. The method of any one of embodiments 120 to 131, wherein the DNA sequence comprised in the second modified corn plant comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

137. The method of any one of embodiments 120 to 131, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

138. The method of embodiment 120, further comprising selecting a progeny corn plant having a desired trait.

139. The method of embodiment 138, wherein the selected progeny corn plant is semi-dwarf and has one or more improved ear traits, relative to a control corn plant.

140. The method of embodiment 138 or 139, wherein the selecting a progeny corn plant having a desired trait comprises the use of one or more molecular techniques.

141. The method of embodiment 140, wherein the one or more molecular techniques are selected from the group consisting of Southern analysis, PCR amplification, Northern blots, RNase protection, primer extension, RT-PCR, Sanger sequencing, Next Generation sequencing technologies, enzymatic assays, protein gel electrophoresis, Western blots, immunoprecipitation, enzyme-linked immunoassays, in situ hybridization, enzyme staining, immunostaining, marker genotyping, and a combination thereof.

142. The method of any one of embodiments 120 to 141, wherein the height at maturity of the progeny corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

143. The method of any one of embodiments 120 to 142, wherein the stalk or stem diameter of the progeny corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

144. The method of any one of embodiments 120 to 143, wherein the progeny corn plant exhibit an ear trait selected from the group consisting of increased ear area, increased single kernel weight, increased ear fresh weight, increased number of florets, and a combination thereof, relative to a control corn plant.

145. The method of any one of embodiments 120 to 144, wherein the progeny corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

146. A method for producing a modified corn plant, the method comprising:
a. introducing into a corn cell a recombinant expression cassette comprising a DNA sequence encoding a CO or COL polypeptide, wherein the DNA sequence is operably linked to a plant-expressible promoter, and wherein the corn cell comprises one or more mutations and/or edits in one or more endogenous GA3 oxidase and/or GA20 oxidase genes; and b. regenerating or developing a modified corn plant from the corn cell, wherein the modified corn plant comprises the recombinant expression cassette and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

147. The method of embodiment 146, further comprising introducing a recombinant DNA construct encoding a guide RNA that targets the one or more endogenous GA3 oxidase and/or GA20 oxidase genes.

148. The method of embodiment 147, wherein the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of a target DNA sequence at or near the genomic locus of one or more endogenous GA3 oxidase and/or GA20 oxidase genes.

149. The method of embodiment 148, wherein the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 34, 35, 36, 37, or 38, or a sequence complementary thereto.

150. The method of any one of embodiments 147 to 149, wherein the guide RNA is a CRISPR RNA (crRNA) or a single-chain guide RNA (sgRNA).

151. The method of any one of embodiments 147 to 150, wherein the guide RNA comprises a sequence complementary to a protospacer adjacent motif (PAM) sequence present in the genome of the corn cell immediately adjacent to a target DNA sequence at or near the genomic locus of the one or more endogenous GA3 oxidase and/or GA20 oxidase genes.

152. The method of any one of embodiments 147 to 151, wherein the one or more endogenous GA3 oxidase and/or GA20 oxidase genes encode a protein that is at least 80%, at least 85%, at least 90%, at least 95%, at least 96%, at least 97%, at least 98%, at least 99%, at least 99.5%, or 100% identical to SEQ ID NO: 9, 12, 15, 30, or 33.

153. The method of embodiment 146, wherein the introducing is via *Agrobacterium*-mediated transformation or particle bombardment.

154. The method of embodiment 153, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

155. The method of embodiment 153, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

156. The method of embodiment 153, wherein the CO or COL polypeptide comprises a *Physcomitrella patens* CONSTANS-like 1 (PpCOL1) polypeptide.

157. The method of any one of embodiments 146 to 156, wherein the DNA sequence comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

158. The method of any one of embodiments 146 to 156, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

159. A method for producing a modified corn plant, the method comprising:

a. mutating or editing one or more endogenous GA3 oxidase genes and/or one or more GA20 oxidase genes in a corn cell, wherein the corn cell comprises a recombinant expression cassette encoding a CO or COL polypeptide, wherein the DNA sequence is operably linked to a plant-expressible promoter; and b. regenerating or developing a modified corn plant from the corn cell, wherein the modified corn plant comprises the recombinant expression cassette and the one or more mutations and/or edits, and wherein the level of expression or activity of the one or more endogenous GA3 oxidase and/or GA20 oxidase genes in the modified corn plant is reduced relative to a control plant not having the one or more mutations and/or edits.

160. The method of embodiment 159, wherein the mutating or editing is obtained by using a site-specific nuclease selected from the group consisting of a RNA-guided endonuclease, a meganuclease, a zinc-finger nuclease (ZFN), a TALE-endonuclease (TALEN), a recombinase, and a transposase.

161. The method of embodiment 159 or 160, further comprising introducing a recombinant DNA construct encoding a guide RNA that targets the one or more endogenous GA3 oxidase and/or GA20 oxidase genes.

162. The method of embodiment 161, wherein the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of a target DNA sequence at or near the genomic locus of one or more endogenous GA3 oxidase and/or GA20 oxidase genes.

163. The method of embodiment 162, wherein the guide RNA comprises a guide sequence that is at least 95%, at least 96%, at least 97%, at least 99% or 100% complementary to at least 10, at least 11, at least 12, at least 13, at least 14, at least 15, at least 16, at least 17, at least 18, at least 19, at least 20, at least 21, at least 22, at least 23, at least 24, or at least 25 consecutive nucleotides of SEQ ID NO: 34, 35, 36, 37, or 38, or a sequence complementary thereto.

164. The method of any one of embodiments 161 to 163, wherein the guide RNA is a CRISPR RNA (crRNA) or a single-chain guide RNA (sgRNA).

165. The method of any one of embodiments 161 to 164, wherein the guide RNA comprises a sequence complementary to a protospacer adjacent motif (PAM) sequence present in the genome of the corn cell immediately adjacent to a target DNA sequence at or near the genomic locus of the one or more endogenous GA3 oxidase and/or GA20 oxidase genes.

166. The method of any one of embodiments 161 to 165, wherein the one or more endogenous GA3 oxidase and/or GA20 oxidase genes encode a protein that is at least 80%, at least 85%, at least 90%, at least 95%, at least 96%, at least 97%, at least 98%, at least 99%, at least 99.5%, or 100% identical to SEQ ID NO: 9, 12, 15, 30, or 33.

167. The method of embodiment 159, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

168. The method of embodiment 159, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

169. The method of embodiment 159, wherein the recombinant expression cassette encodes a *Physcomitrella patens* CONSTANS-like 1 (PpCOL1) polypeptide.

170. The method of embodiment 159, wherein the recombinant expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

171. The method of embodiment 159, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

172. The method of any one of embodiments 159 to 171, further comprising selecting a modified corn plant having a desired trait.

173. The method of embodiment 172, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

174. The method of embodiment 173, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

175. The method of any one of embodiments 172 to 174, wherein the modified corn plant exhibit an ear trait selected from the group consisting of increased ear area, increased single kernel weight, increased ear fresh weight, increased number of florets, and a combination thereof, relative to a control corn plant.

176. The method of any one of embodiments 172 to 175, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

177. A modified corn plant comprising 1) one or more mutations or edits at or near one or more endogenous GA20 oxidase and/or GA3 oxidase genes, wherein the expression or activity of the one or more endogenous GA20 oxidase and/or GA3 oxidase genes is reduced relative to a wildtype control plant, and 2) a recombinant expression cassette comprising a DNA sequence encoding a CO or COL polypeptide, wherein the DNA sequence is operably linked to a plant-expressible promoter.

178. The modified corn plant of embodiment 177, wherein the modified corn plant is semi-dwarf and has one or more improved ear traits, relative to a control corn plant that does not comprise both the one or more mutations or edits and the recombinant expression cassette.

179. The modified corn plant of embodiment 177 or 178, wherein the one or more mutations or edits are selected from the group consisting of an insertion, a substitution, an inversion, a deletion, a duplication, and a combination thereof.

180. The modified corn plant of any one of embodiments 177 to 179, wherein the one or more mutations or edits are introduced using a meganuclease, a zinc-finger nuclease (ZFN), a RNA-guided endonuclease, a TALE-endonuclease (TALEN), a recombinase, or a transposase.

181. The modified corn plant of any one of embodiments 177 to 180, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

182. The modified corn plant of any one of embodiments 177 to 180, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

183. The modified corn plant of any one of embodiments 177 to 180, wherein CO or COL polypeptide comprises a *Physcomitrella patens* CONSTANS-like 1 (PpCOL1) polypeptide.

184. The modified corn plant of any one of embodiments 177 to 180, wherein the DNA sequence comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

185. The modified corn plant of any one of embodiments 177 to 180, the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

186. The modified corn plant of any one of embodiments 177 to 185, wherein the recombinant expression cassette is stably integrated into the genome of the modified corn plant.

187. The modified corn plant of any one of embodiments 177 to 186, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to a control corn plant.

188. The modified corn plant of any one of embodiments 177 to 187, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to a control corn plant.

189. The modified corn plant of any one of embodiments 177 to 188, wherein the modified corn plant exhibits improved lodging resistance, reduced green snap, or both, relative to the control corn plant.

190. The modified corn plant of any one of embodiments 177 to 189, wherein the modified corn plant exhibits increased ear area relative to a control corn plant.

191. The modified corn plant of any one of embodiments 177 to 190, wherein the modified corn plant exhibits increased single kernel weight relative to a control corn plant.

192. The modified corn plant of any one of embodiments 177 to 191, wherein the modified corn plant exhibits increased ear fresh weight relative to a control corn plant.

193. The modified corn plant of any one of embodiments 177 to 192, wherein the modified corn plant exhibits increased number of florets relative to a control corn plant.

194. The modified corn plant of any one of embodiments 177 to 193, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to a control corn plant.

195. The modified corn plant of any one of embodiments 177 to 194, wherein the modified corn plant does not have any significant off-types in at least one female organ or ear.

196. A plurality of modified corn plants in a field, each modified corn plant comprising
   a. one or more mutations or edits at or near one or more endogenous GA20 oxidase and/or GA3 oxidase genes, wherein the expression of the one or more endogenous GA20 oxidase and/or GA3 oxidase genes are reduced relative to a wildtype control plant, and
   b. a recombinant expression cassette comprising a DNA sequence encoding a CO or COL polypeptide, wherein the DNA sequence is operably linked to a plant-expressible promoter.

197. The plurality of modified corn plants of embodiment 196, wherein the modified corn plants have increased yield relative to control corn plants.

198. The plurality of modified corn plants of embodiment 196 or 197, wherein the modified corn plants have an increase in yield that is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, or at least 25% greater than control corn plants.

199. A recombinant DNA construct comprising 1) a first expression cassette comprising a transcribable DNA sequence encoding a non-coding RNA for suppression of one or more GA20 oxidase or one or more GA3 oxidase genes, and 2) a second expression cassette comprising a DNA sequence encoding a CO or COL polypeptide, wherein the DNA sequence is operably linked to a plant-expressible promoter.

200. The recombinant DNA construct of embodiment 199, wherein the first and second expression cassettes are in a single T-DNA segment of a transformation vector.

201. The recombinant DNA construct of embodiment 199, wherein the first and second expression cassettes are in two different T-DNA segments of a transformation vector.

202. The recombinant DNA construct of any one of embodiments 199 to 201, wherein the transcribable DNA sequence encodes a non-coding RNA for suppression of a GA3 oxidase gene.

203. The recombinant DNA construct of embodiment 202, wherein the transcribable DNA sequence encodes a non-coding RNA for suppression of a GA3 oxidase_1 gene, a GA3 oxidase_2 gene, or both.

204. The recombinant DNA construct of embodiment 203, wherein the transcribable DNA sequence comprises a sequence that is at least 80%, at least 85%, at least 90%, at least 95%, at least 96%, at least 97%, at least 98%, at least 99%, at least 99.5%, or 100% identical or complementary to at least 15, at least 16, at least 17, at least 18, at least 19, at least 20, at least 21, at least 22, at least 23, at least 24, at least 25, at least 26, or at least 27 consecutive nucleotides of one or more of SEQ ID NOs: 28, 29, 31, 32, 36, and 37.

205. The recombinant DNA construct of embodiment 203, wherein the transcribable DNA sequence encodes a non-coding RNA comprising a sequence that is 80% complementary to at least 15 consecutive nucleotides of one or more of SEQ ID NOs: 28, 29, 31, 32, 36, and 37.

206. The recombinant DNA construct of embodiment 202, wherein the transcribable DNA sequence encodes a non-coding RNA for suppression of a GA20 oxidase gene.

207. The recombinant DNA construct of embodiment 206, wherein the transcribable DNA sequence encodes a non-coding RNA for suppression of a GA20 oxidase_3 gene, a GA20 oxidase_4 gene, a GA20 oxidase_5 gene, or a combination thereof.

208. The recombinant DNA construct of embodiment 206, wherein the transcribable DNA sequence encodes a non-coding RNA for suppression of a GA20 oxidase_3 gene, a GA20 oxidase_5 gene, or both.

209. The recombinant DNA construct of embodiment 208, wherein the transcribable DNA sequence comprises a sequence that is at least 80% identical or complementary to at least 15 consecutive nucleotides of SEQ ID NO: 39, 53, or 55.

210. The recombinant DNA construct of embodiment 209, wherein the transcribable DNA sequence encodes a sequence that is at least 80% identical or complementary to at least 15 consecutive nucleotides of SEQ ID NO: 40, 54, or 56.

211. The recombinant DNA construct of any one of embodiments 199 to 210, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of a mRNA molecule encoding an endogenous GA oxidase protein in a corn plant or plant cell, the endogenous GA oxidase protein being at least 80%, at least 85%, at least 90%, at least 95%, at least 96%, at least 97%, at least 98%, at least 99%, at least 99.5%, or 100% identical to SEQ ID NO: 9, 12, 15, 30, or 33.

212. The recombinant DNA construct of any one of embodiments to 199 to 211, wherein the non-coding RNA comprises a sequence that is at least 80%, at least 85%, at least 90%, at least 95%, at least 96%, at least 97%, at least 98%, at least 99%, at least 99.5%, or 100% complementary to at least 15, at least 16, at least 17, at least 18, at least 19, at least 20, at least 21, at least 22, at least 23, at least 24, at least 25, at least 26, or at least 27 consecutive nucleotides of SEQ ID NO: 7, 8, 10, 11, 13, 14, 28, 29, 31, or 32.

213. The recombinant DNA construct of any one of embodiments 199 to 212, wherein the DNA sequence comprised in the second expression cassette comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

214. The recombinant DNA construct of any one of embodiments 199 to 212, wherein the DNA sequence comprised in the second expression cassette comprises a sequence that encodes a protein having an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

215. The recombinant DNA construct of any one of embodiments 199 to 212, wherein the DNA sequence comprised in the second expression cassette encodes a *Physcomitrella patens* CONSTANS-like 1 (PpCOL1) polypeptide.

216. The recombinant DNA construct of any one of embodiments 199 to 212, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

217. The recombinant DNA construct of any one of embodiments 199 to 212, wherein the DNA sequence comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

218. The recombinant DNA construct of any one of embodiments 199 to 215, the plant-expressible promoter is a vascular promoter.

219. The recombinant DNA construct of embodiment 218, wherein the vascular promoter is selected from the group consisting of a sucrose synthase promoter, a sucrose transporter promoter, a Sh1 promoter, CoYMV promoter, a WDV large intergenic region (LIR) promoter, a MSV coat polypeptide (CP) promoter, a rice yellow stripe 1 (YS1)-like promoter, a rice yellow stripe 2 (OsYSL2) promoter, and a combination thereof.

220. The recombinant DNA construct of any one of embodiments 199 to 215, wherein the plant-expressible promoter is an RTBV promoter.

221. The recombinant DNA construct of any one of embodiments 199 to 215, wherein the plant-expressible promoter is a leaf promoter.

222. The recombinant DNA construct of embodiment 221, wherein the leaf promoter is selected from the group consisting of a RuBisCO promoter, a PPDK promoter, a FDA promoter, a Nadh-Gogat promoter, a chlorophyll a/b binding polypeptide gene promoter, a PEPC promoter, a Myb gene promoter, and a combination thereof.

223. The recombinant DNA construct of any one of embodiments 199 to 215, wherein the plant-expressible promoter is a constitutive promoter.

224. The recombinant DNA construct of embodiment 223, wherein the constitutive promoter is selected from the group consisting of an actin promoter, a CaMV 35S or 19S promoter, a plant ubiquitin promoter, a plant Gos2 promoter, a FMV promoter, a CMV promoter, a MMV promoter, a PCLSV promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

225. The recombinant DNA construct of any one of embodiments 199 to 215, wherein the plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 172 or a functional portion thereof.

226. The recombinant DNA construct of embodiment 199, wherein the non-coding RNA is a precursor miRNA or siRNA capable of being processed or cleaved to form a mature miRNA or siRNA.

227. A transformation vector comprising the recombinant DNA construct of any one of embodiments 199 to 226.

228. A modified corn plant or a plant part thereof comprising the recombinant DNA construct of embodiment 227.

229. The modified corn plant of embodiment 228, wherein the modified corn plant is semi-dwarf and has one or more improved ear traits, relative to a control corn plant not having both the first and second expression cassettes.

230. The modified corn plant of embodiment 229, wherein the height at maturity of the modified corn plant is reduced by at least 1%, at least 2%, at least 5%, at least 10%, at least 15%, at least 20%, at least 25%, at least 30%, at least 35%, at least 40%, at least 45%, at least 50%, at least 55%, at least 60%, at least 65%, or at least 70%, relative to the control corn plant.

231. The modified corn plant of embodiment 229, wherein the stalk or stem diameter of the modified corn plant is increased by at least 0.1%, at least 0.2%, at least 0.5%, at least 1%, at least 1.5%, at least 2%, at least 2.5%, at least 3%, at least 3.5%, at least 4%, at least 4.5%, at least 5%, at least 6%, at least 7%, at least 8%, at least 9%, at least 10%, at least 15%, at least 20%, at least 25%, at least 30%, at least 35%, at least 40%, at least 45%, or at least 50%, relative to the control corn plant.

232. The modified corn plant of embodiment 229, wherein the modified corn plant exhibits improved lodging resistance, reduced green snap, or both, relative to the control corn plant.

233. The modified corn plant of embodiment 229, wherein the modified corn plant exhibits increased ear area relative to the control corn plant.

234. The modified corn plant of embodiment 229, wherein the modified corn plant exhibits increased single kernel weight relative to the control corn plant.

235. The modified corn plant of embodiment 229, wherein the modified corn plant exhibits increased ear fresh weight relative to the control corn plant.

236. The modified corn plant of embodiment 229, wherein the modified corn plant exhibits increased number of florets relative to the control corn plant.

237. The modified corn plant of embodiment 229, wherein the modified corn plant exhibits a trait selected from the group consisting of deeper roots, increased leaf area, earlier canopy closure, higher stomatal conductance, lower ear height, increased foliar water content, improved drought tolerance, improved nitrogen use efficiency, reduced anthocyanin content and area in leaves under normal or nitrogen-limiting or water-limiting stress conditions, increased ear weight, increased harvest index, increased yield, increased seed number, increased seed weight, increased prolificacy, and a combination thereof, relative to the control corn plant.

238. The modified corn plant of embodiment 229, wherein the modified corn plant does not have any significant off-types in at least one female organ or ear.

239. A recombinant DNA donor template molecule for site directed integration of an insertion sequence into the genome of a corn plant comprising an insertion sequence and at least one homology sequence, wherein the homology sequence is at least 70%, at least 75%, at least 80%, at least 85%, at least 90%, at least 95%, at least 96%, at least 97%, at least 99% or 100% complementary to at least 20, at least 25, at least 30, at least 35, at least 40, at least 45, at least 50, at least 60, at least 70, at least 80, at least 90, at least 100, at least 150, at least 200, at least 250, at least 500, at least 1000, at least 2500, or at least 5000 consecutive nucleotides of a target DNA sequence in the genome of a corn plant cell, and wherein the insertion sequence comprises an expression cassette comprising a DNA sequence encoding a CO or COL polypeptide, wherein the DNA sequence is operably linked to a plant-expressible promoter.

240. The recombinant DNA donor template molecule of embodiment 239, comprising two of the homology sequences, wherein the two homology sequences flank the insertion sequence.

241. The recombinant DNA donor template molecule of embodiment 239 or 240, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 176-397.

242. The recombinant DNA donor template molecule of embodiment 239 or 240, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to one or more of SEQ ID NOs: 398-452.

243. The recombinant DNA donor template molecule of embodiment 239 or 240, wherein the CO or COL polypeptide comprises a *Physcomitrella patens* CONSTANS-like 1 (PpCOL1) polypeptide.

244. The recombinant DNA donor template molecule of embodiment 239 or 240, wherein the DNA sequence comprised in the expression cassette comprises a sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 169.

245. The recombinant DNA donor template molecule of embodiment 239 or 240, wherein the CO or COL polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or 100% identical to SEQ ID NO: 168.

246. The recombinant DNA donor template molecule of any one of embodiments 239 to 245, wherein the plant-expressible promoter comprises a DNA sequence that is at least 80%, at least 85%, at least 90%, at least 95%, at least 96%, at least 97%, at least 98%, at least 99%, at least 99.5% or 100% identical to SEQ ID NO: 172 or a functional portion thereof.

247. The recombinant DNA donor template molecule of any one of embodiments 239 to 246, further comprising a transcribable DNA sequence encoding a non-coding RNA for suppression of one or more GA20 oxidase genes and/or one or more GA3 oxidase genes, wherein the transcribable DNA sequence is operably linked to a promoter.

248. The recombinant DNA donor template molecule of embodiment 247, wherein the promoter is a vascular promoter.

249. The recombinant DNA donor template molecule of embodiment 248, wherein the vascular promoter is selected from the group consisting of a sucrose synthase promoter, a sucrose transporter promoter, a Sh1 promoter, *Commelina* yellow mottle virus (CoYMV) promoter, a wheat dwarf geminivirus (WDV) large intergenic region (LIR) promoter, a maize streak geminivirus (MSV) coat polypeptide (CP) promoter, a rice yellow stripe 1 (YS1)-like promoter, a rice yellow stripe 2 (OsYSL2) promoter, and a combination thereof.

250. The recombinant DNA donor template molecule of embodiment 249, wherein the vascular promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 67, SEQ ID NO: 68, SEQ ID NO: 69, SEQ ID NO: 70, or SEQ ID NO: 71, or a functional portion thereof.

251. The recombinant DNA donor template molecule of any one of embodiments 239 to 245, wherein the promoter is a rice tungro bacilliform virus (RTBV) promoter.

252. The recombinant DNA donor template molecule of embodiment 251, wherein the RTBV promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 65 or SEQ ID NO: 66, or a functional portion thereof.

253. The recombinant DNA donor template molecule of any one of embodiments 239 to 245, wherein the promoter is a leaf promoter.

254. The recombinant DNA donor template molecule of embodiment 253, wherein the leaf promoter is selected from the group consisting of a RuBisCO promoter, a pyruvate phosphate dikinase (PPDK) promoter, a fructose 1-6 bisphosphate aldolase (FDA) promoter, a Nadh-Gogat promoter, a chlorophyll a/b binding polypeptide gene promoter, a phosphoenolpyruvate carboxylase (PEPC) promoter, a Myb gene promoter, and a combination thereof.

255. The recombinant DNA donor template molecule of embodiment 254, wherein the leaf promoter comprises a DNA sequence that is at least 80%, at least 85%, at least 90%, at least 95%, at least 96%, at least 97%, at least 98%, at least 99%, at least 99.5% or 100% identical to one or more of SEQ ID NO: 72, SEQ ID NO: 73 or SEQ ID NO: 74, or a functional portion thereof.

256. The recombinant DNA donor template molecule of any one of embodiments 239 to 245, wherein the promoter is a constitutive promoter.

257. The recombinant DNA donor template molecule of embodiment 256, wherein the constitutive promoter is selected from the group consisting of an actin promoter, a Cauliflower mosaic virus (CaMV) 35S or 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, or a maize alcohol dehydrogenase, a functional portion thereof, and a combination thereof.

258. The recombinant DNA donor template molecule of embodiment 257, wherein the constitutive promoter comprises a DNA sequence that is at least 80%, at least 85%, at least 90%, at least 95%, at least 96%, at least 97%, at least 98%, at least 99%, at least 99.5% or 100% identical to one or more of SEQ ID NOs: 75, SEQ ID NO: 76, SEQ ID NO: 77, SEQ ID NO: 78, SEQ ID NO: 79, SEQ ID NO: 80, SEQ ID NO: 81, SEQ ID NO: 82 or SEQ ID NO: 83, or a functional portion thereof.

259. The modified corn plant of embodiment 1, wherein the first recombinant expression cassette comprises SEQ ID NO: 39, and the second recombinant expression cassette comprises SEQ ID NO: 169.

260. The modified corn plant of embodiment 259, wherein the modified corn plant is semi-dwarf and exhibits one or more improved ear traits, relative to a control plant that does not comprise the first or second recombinant expression cassette.

261. The modified corn plant of embodiment 260, wherein the one or more improved ear traits are selected from the group consisting of ear area, ear volume, ear diameter, ear length, kernels per ear, single kernel weight, grain yield estimate, broad acreage yield, and a combination thereof.

262. A modified corn plant or a plant part thereof comprising 1) a first transcribable DNA sequence comprising SEQ ID NO: 39, and 2) a second transcribable DNA sequence comprising SEQ ID NO: 169.

263. The modified corn plant of embodiment 262, wherein the modified corn plant is semi-dwarf and has one or more improved ear traits, relative to a control corn plant that does not have the first or second transcribable DNA sequence.

264. The modified corn plant of embodiment 263, wherein the one or more improved ear traits are selected from the group consisting of ear area, ear volume, ear diameter, ear length, kernels per ear, single kernel weight, grain yield estimate, broad acreage yield, and a combination thereof.

265. A method for producing a modified corn plant, the method comprising
   a. introducing into a corn cell a recombinant expression cassette comprising a first transcribable DNA sequence comprising SEQ ID NO: 39, and a second transcribable DNA sequence comprising SEQ ID NO: 169;
   b. regenerating or developing a modified corn plant from the corn cell, wherein the modified corn plant comprises the first and second transcribable DNA sequences.

266. The method of embodiment 265, wherein the modified corn plant is semi-dwarf and has one or more improved ear traits, relative to a control corn plant that does not have the first or second transcribable DNA sequence.

267. The method of embodiment 266, wherein the one or more improved ear traits are selected from the group consisting of ear area, ear volume, ear diameter, ear length, kernels per ear, single kernel weight, grain yield estimate, broad acreage yield, and a combination thereof.

268. A recombinant expression cassette comprising 1) a first transcribable DNA sequence comprising SEQ ID NO: 39, and 2) a second transcribable DNA sequence comprising SEQ ID NO: 169.

EXAMPLES

Example 1. Generation of the GA20Ox_SUP/PpCOL Stack Plants

An inbred corn plant line was transformed via *Agrobacterium*-mediated transformation with a transformation vector having an expression construct comprising a miRNA-encoding DNA sequence (SEQ ID NO: 39) encoding a targeting sequence (SEQ ID NO: 40) under the control of a rice tungro bacilliform virus (RTBV) promoter (SEQ ID NO: 65) known to cause expression in vascular tissues of plants. The miRNA encoded by the construct comprises an RNA sequence that targets the GA20 oxidase_3 and GA20 oxidase_5 genes in corn plants. Several transformation events were generated therefrom. The resulting transformed/transgenic inbred line is herein referred to as GA20Ox_SUP or GA20Ox_SUP single.

Similarly, an inbred corn plant line was transformed via *Agrobacterium*-mediated transformation with a transformation vector having an expression construct comprising a transgene (SEQ ID NO: 169) encoding *Physcomitrella patens* CONSTANS-like (PpCOL) polypeptide (SEQ ID NO: 168). The expression construct comprises an *Oryza sativa* enhancer (SEQ ID NO: 170), a CaMV 35S enhancer (SEQ ID NO: 171), an *Oryza sativa* promoter (SEQ ID NO: 172), a leader sequence (SEQ ID NO: 173), an intron sequence (SEQ ID NO: 174), and a terminator sequence (SEQ ID NO: 175) Several transformation events were generated therefrom. The resulting transformed/transgenic inbred line is herein referred to as PpCOL, PpCOL transgenic plant, or PpCOL single. PpCOL1 and PpCOL are used interchangeably.

The parental GA20Ox_SUP and PpCOL singles were crossed to create a stacked transgenic progeny plant comprising both the PpCOL transgene and the miRNA-encoding DNA sequence for the suppression of GA20 oxidase_3 and GA20 oxidase_5 genes. The resulting stacked transgenic line is herein referred to as GA20Ox_SUP/PpCOL stack. The GA20Ox_SUP/PpCOL stack can be inbred stack if the parental lines are of the same inbred line origin, or hybrid when the parental lines are of different inbreds.

For each type of transgenic single and stack plants, the corresponding control plants were also produced for comparison having the same inbred line or same parental line combination, but without the transgenic GA20Ox_SUP and PpCOL constructs.

Example 2. Reduced Height of the GA20Ox_SUP/PpCOL Stack Plants

GA20Ox_SUP/PpCOL stack plants were grown to maturity in a field under standard agronomic practice and their heights are measured. Plant height was measured as the plot average from the soil line to the base of highest collared leaf at the R3 stage. A sufficient number of plants were measured to meet statistical significance with p-value ≤0.2. Control plants of the same parental inbred lines but without the GA20Ox_SUP and PpCOL transgenic constructs were also grown under similar conditions.

Average plant height reduction for each of four breeding or crossing stack event combinations of the GA20Ox_SUP/PpCOL transgenes ("Stack-1" to "Stack-4") is shown in FIG. 1 relative to control plants. As shown in FIG. 1, a statistically significant reduction in plant height averaging between 30 to 35% was consistently observed in GA20Ox_SUP/PpCOL stack plants relative to control plants.

Example 3. Enhanced Ear Traits of PpCOL Single Plants

Transgenic single and stack plants, along with control plants as described in Example 1, were grown under standard agronomic practice. For GA20Ox_SUP and PpCOL singles, plants of two to four transformation events were chosen, with corresponding event combinations in the GA20Ox_SUP/PpCOL stack. Several corn ear traits were measured at the R6 stage.

Ear area is measured as the plot average of the size of the area of an ear from a two-dimensional view. The measurement is conducted via imaging of the ear, including kernels and void. Typically, 10 representative ears are measured per plot. Ear fresh weight is measured as the plot average of the ear weight of a plant at the R6 stage.

Grain yield estimate is measured as the conversion from hand-harvested grain weight per area, collected from a small section of a plot, to the equivalent of bushels per acre, including adjustment to a standard moisture level.

Single kernel weight is measured as the plot average of weight per kernel, calculated as the ratio of (sample kernel weight adjusted to a standard moisture level)/(sample kernel number). The sample kernel number ranges from 350 to 850.

Figure 2:
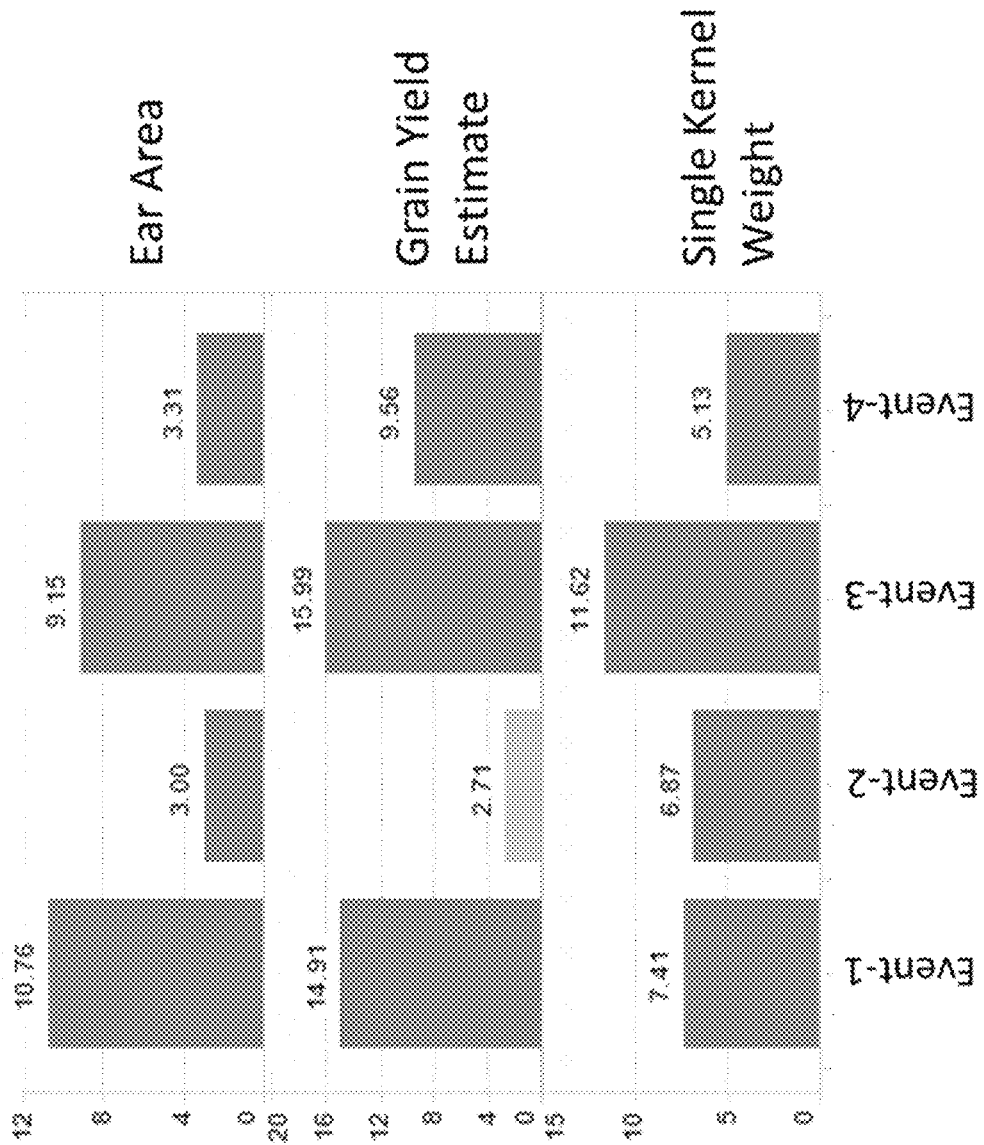
FIG. 2 shows ear traits of stacked GA20Ox_SUP/PpCOL plants across four transformation events including ear area, grain yield estimate, and single kernel weight, relative to control plants.

FIG. 2 shows ear trait results for PpCOL single plants from four transformation events in one growing season. Results were shown as percent difference (delta) between PpCOL single plants and control plants of the same inbred without the PpCOL transgenic construct. The dark gray bars in FIG. 2 are indicative of a statistically significant difference in ear area, grain yield estimate, and single kernel weight relative to control plants (p-value ≤0.2). The light gray bar is indicative of numerically positive improvement in grain yield estimate.

As shown in FIG. 2, statistically significant improvements or increases in ear area, grain yield estimate, and single kernel weight relative to control plants were observed in all four PpCOL single transformation events ("Event-1" to "Event-4"), with the exception that Event-2 showed a non-statistically positive trend or increase in grain yield estimate.

Figure 3:
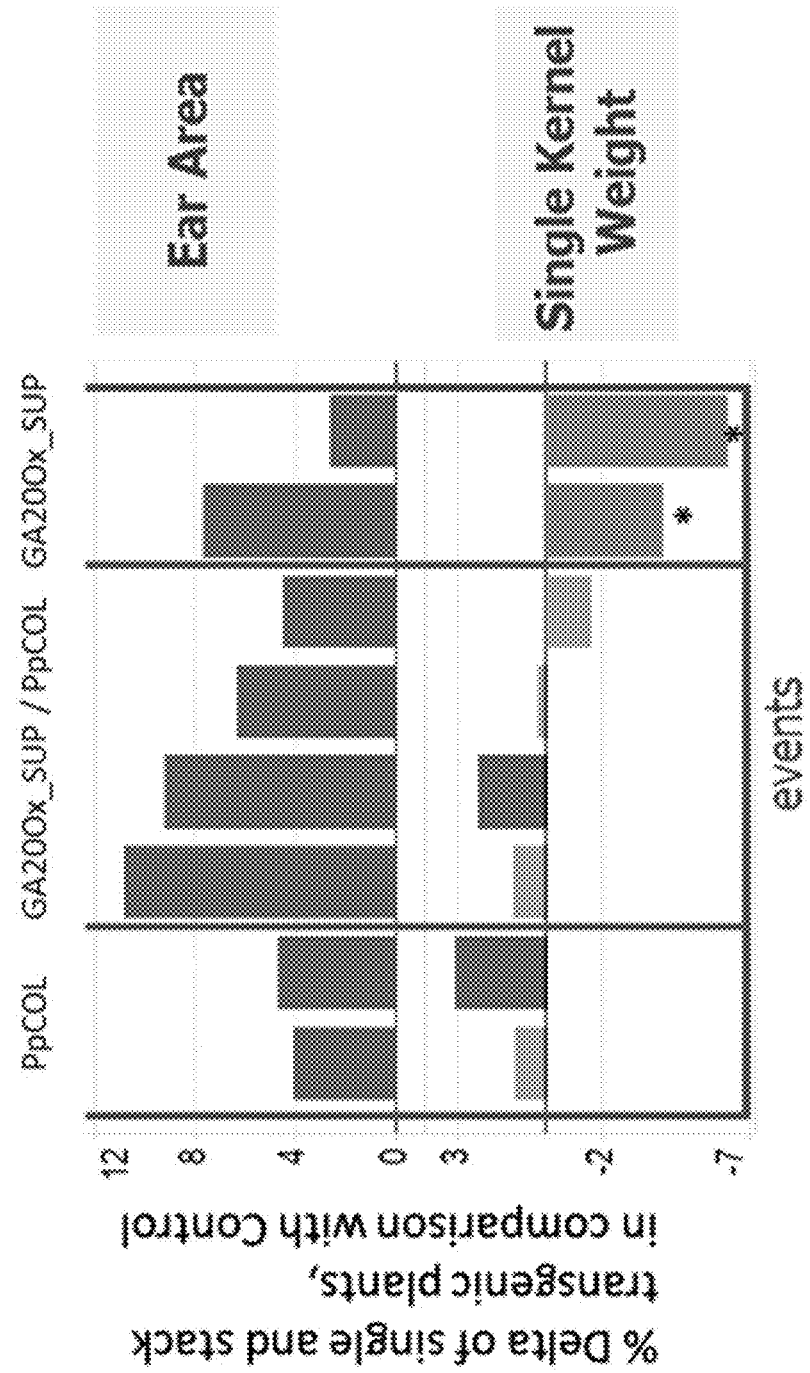
FIG. 3 shows ear area and single kernel weight of stacked GA20Ox_SUP/PpCOL plants relative to control plants.

Example 4. Enhanced Ear Area and Single Kernel Weight of GA20Ox_SUP/PpCOL Stack Plants Ear traits were measured with GA20Ox_SUP single, PpCOL single, and GA20Ox_SUP/PpCOL stack plants, and positive effects or traits were observed when both the GA20Ox_SUP and PpCOL constructs were present in a plant. As shown in FIG. 3, ear area and single kernel weight were measured in two events of the GA20OX_SUP single, two events of the PpCOL single, and four breeding stack event combinations of the GA20Ox_SUP/PpCOL transgenes grown in a single growing season, with each bar indicating one transformation event. Dark gray bars in FIG. 3 are indicative of statistically significant positive changes (p-value ≤0.2), and light gray bars are indicative of numerically, but not statistically significant, positive or negative changes. Asterisk (*) indicates significant negative changes (p-value ≤0.2).

Positive effects were observed in the GA20Ox_SUP/PpCOL stack plants. As shown in FIG. 3, PpCOL single events demonstrated improved ear area and single kernel weight relative to control plants. The PpCOL single and GA20Ox_SUP single plants each showed a significantly increased ear area relative to control plants, and PpCOL single plants showed increased single kernel weight relative to control plants. GA20Ox_SUP/PpCOL stack plants also demonstrated a statistically significant increase in ear area relative to control plants. Moreover, the average increase in ear area with the four breeding stack event combinations in GA20Ox_SUP/PpCOL stack plants was greater than that of the PpCOL single or GA20Ox_SUP single plants. Similarly, the GA20Ox_SUP/PpCOL stack plants had an increased single kernel weight relative to control, as compared to the GA20Ox_SUP single plants.

These results show that GA20Ox_SUP/PpCOL stack plants have enhanced ear traits, such as increased ear area and single kernel weight, compared to control plants, PpCOL single plants, and/or GA20Ox_SUP single plants.

Example 5. Increased Ear Fresh Weight of GA20Ox_SUP/PpCOL Stack Plants

Figure 4:
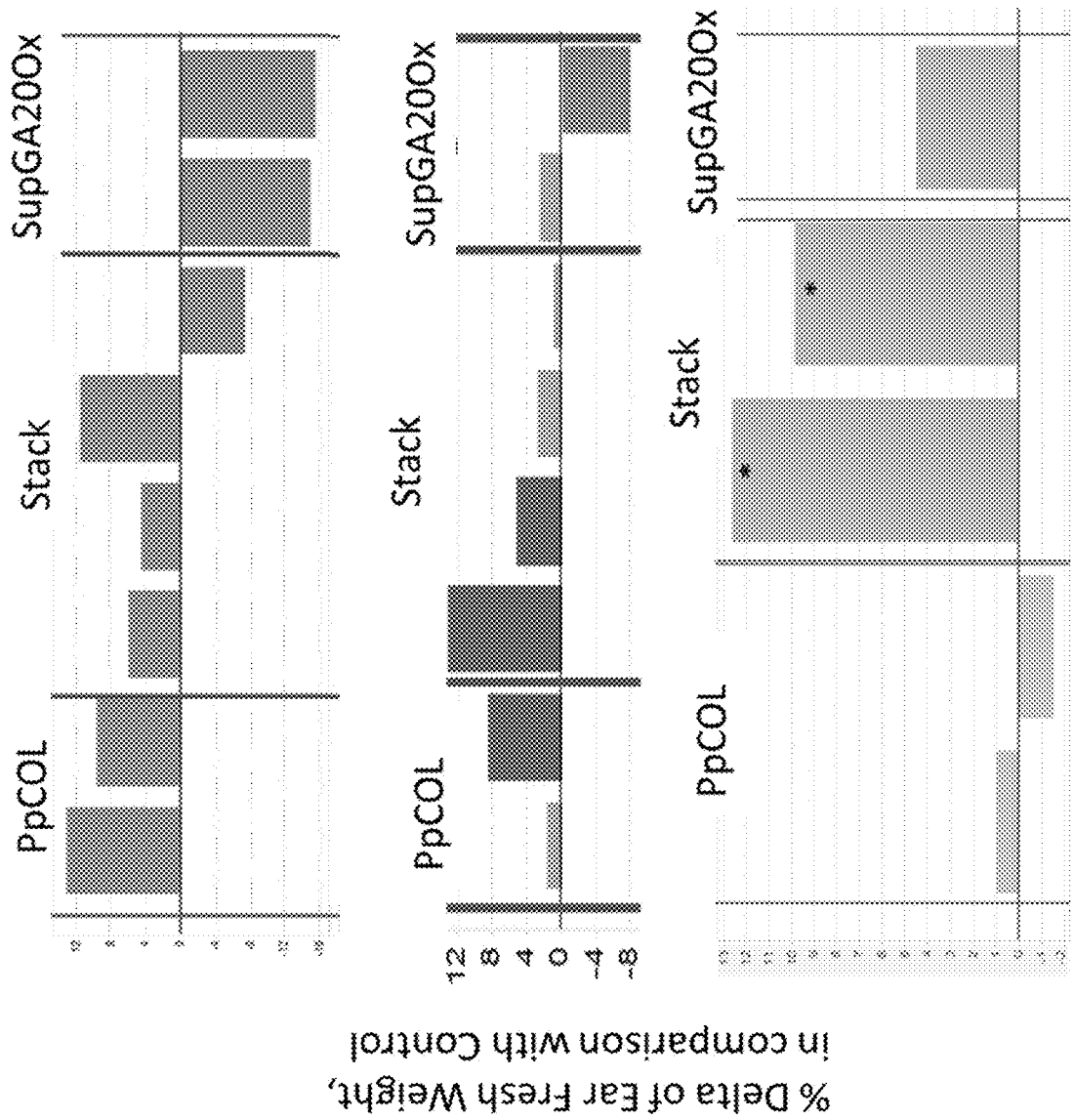
FIG. 4 shows ear fresh weight of GA20Ox_SUP/PpCOL stack plants in three consecutive growing seasons relative to control plants.

FIG. 4 provides the percent difference in ear fresh weight of PpCOL single, GA20Ox_SUP single, and GA20Ox_SUP/PpCOL stack plants relative to control plants over three consecutive growing seasons. Each bar in FIG. 4 is for a single event or a stacked combination of transformation events. Dark gray bars or those with an asterisk (*) are indicative of statistically significant positive or negative differences (p-value ≤0.2), and light gray bars are indicative of numerically positive or negative, but not statistically significant, improvements or differences (increase or decrease).

Though the PpCOL single and GA20Ox_SUP single plants showed variation in ear fresh weight over three years, GA20Ox_SUP/PpCOL stack plants showed consistent and significant improvement of ear fresh weight over control plants, across years and event combinations. The increase in ear fresh weight with GA20Ox_SUP/PpCOL stack plants suggests that plants containing the GA20Ox_SUP/PpCOL stack combination could have improved and/or stabilized yield across growing seasons and environments.

Example 6. Increased Floret Numbers in the GA20Ox_SUP/PpCOL Stack Plants

Phenotypic analysis was conducted on R1 stage ears collected from GA20Ox_SUP single, PpCOL single, and GA20Ox_SUP/PpCOL stack plants, along with control plants. The number of florets is an early indicator of the number of potential corn kernels. Five plants and ears per genotype/event were used to sample the total number of unpollinated ear florets at R1 stage. To calculate total floret numbers, R1 ears were dissected from each plant, and for each ear, the number of longitudinal florets (rank number) was multiplied by the number of florets across the diameter of the ear (row number). A Student's-t test was then conducted to analyze and group the results.

Figure 5:
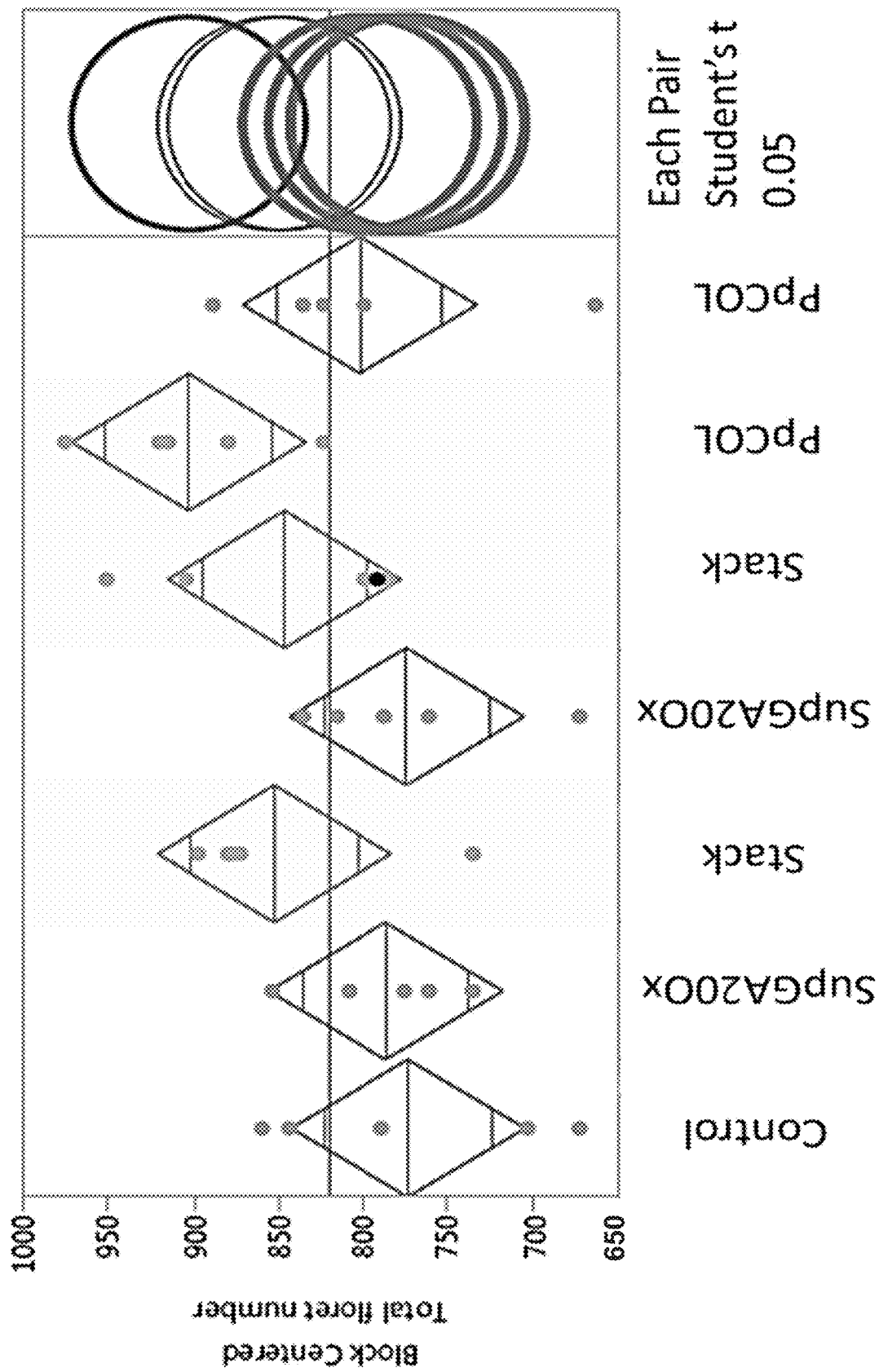
FIG. 5 shows the number of florets in GA20Ox_SUP/PpCOL stack plants relative to control plants.

As shown in FIG. 5, all GA20Ox_SUP/PpCOL stack plants (and one PpCOL single plant) showed a statistically significant increase in the number of florets per ear relative to control plants and/or GA20Ox_SUP single plants.

Example 7. Identification of CONSTANS (CO) and CONSTANS-Like (COL) Gene Homologs Sixty-eight CONSTANS (CO) and CONSTANS-like (COL) homologs were identified from *Arabidopsis*, rice, soybean and barley, and the CO/COL protein sequences were further searched in Genbank® to identify additional CO/COL homologs from various plant species using BlastP (e-value cutoff of 1e-10). The preliminary search results were then filtered to identify those having a full amino acid sequence with a starting methionine, and a CCT domain (HMMSEARCH vs. CCT Pfam, using gathering threshold cutoff) and one or two Zinc finger B-box domain(s) (HMMERSEARCH vs. zf-B_box Pfam, using gathering threshold cutoff). Compiled results of these searches include proteins having the following amino acid sequences: SEQ ID NOs: 176-397 (single B-box domain) and SEQ ID NOs: 398-452 (two B-box domains).

Figure 6:
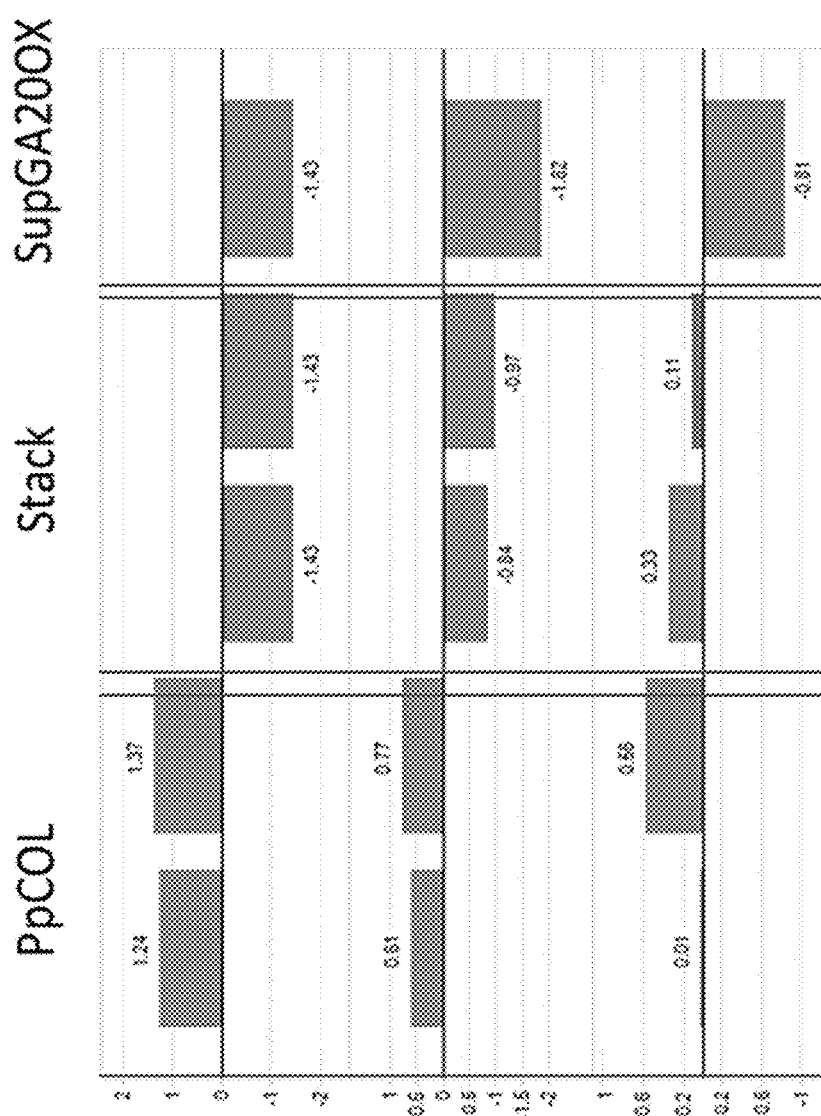
FIG. 6 shows the plot average of the number of green leaves from 0, 7, and 14 days after the onset of the R5 stage for GA20Ox_SUP/PpCOL stack plants relative to control plants.

Example 8. Green Leaf Number for GA200X_SUP/PpCOL Stack Plants During Later Reproductive Stage The number of green leaves during reproductive stages can have an impact on corn yield. FIG. 6 shows the plot average of the number of green leaves at 0, 7, and 14 days after the onset of the R5 stage for GA20Ox_SUP single, PpCOL single, and GA20Ox_SUP/PpCOL stack plants. The data in FIG. 6 is presented as the difference (or delta) between the transgenic plants and control.

As shown in FIG. 6, the green leaf number of GA20Ox_SUP/PpCOL stack plants was similar to the number of green leaves on control plants during the R5 stage at day 0 and day 7, with a slight reduction in the number of green leaves on during the R5 stage at day 14 relative to control plants, and the number of green leaves on GA20Ox_SUP single plants was slightly less than control plants during the R5 stage of development.

Example 9. Flowering and Pollen Shedding in GA200X_SUP/PpCOL Stack Plants

Variation in flowing time and differences in timing between pollen shed and silk emergence can impact corn yields.

As used herein, days to 50% pollen shedding (or days to pollen) measures the number of days between planting and the day when 50% of the plants reach the pollen shedding stage. Days to 50% visible silk (or days to silk) measures the number of days between planting and the day when 50% of the plants reach visible silking at the R1 stage. Anthesis-silking interval (ASI) measures the days between pollination and silking for 50% of the plants. A smaller ASI (i.e., closer to zero) tends to have a relatively positive effect on corn yield.

Figure 7:
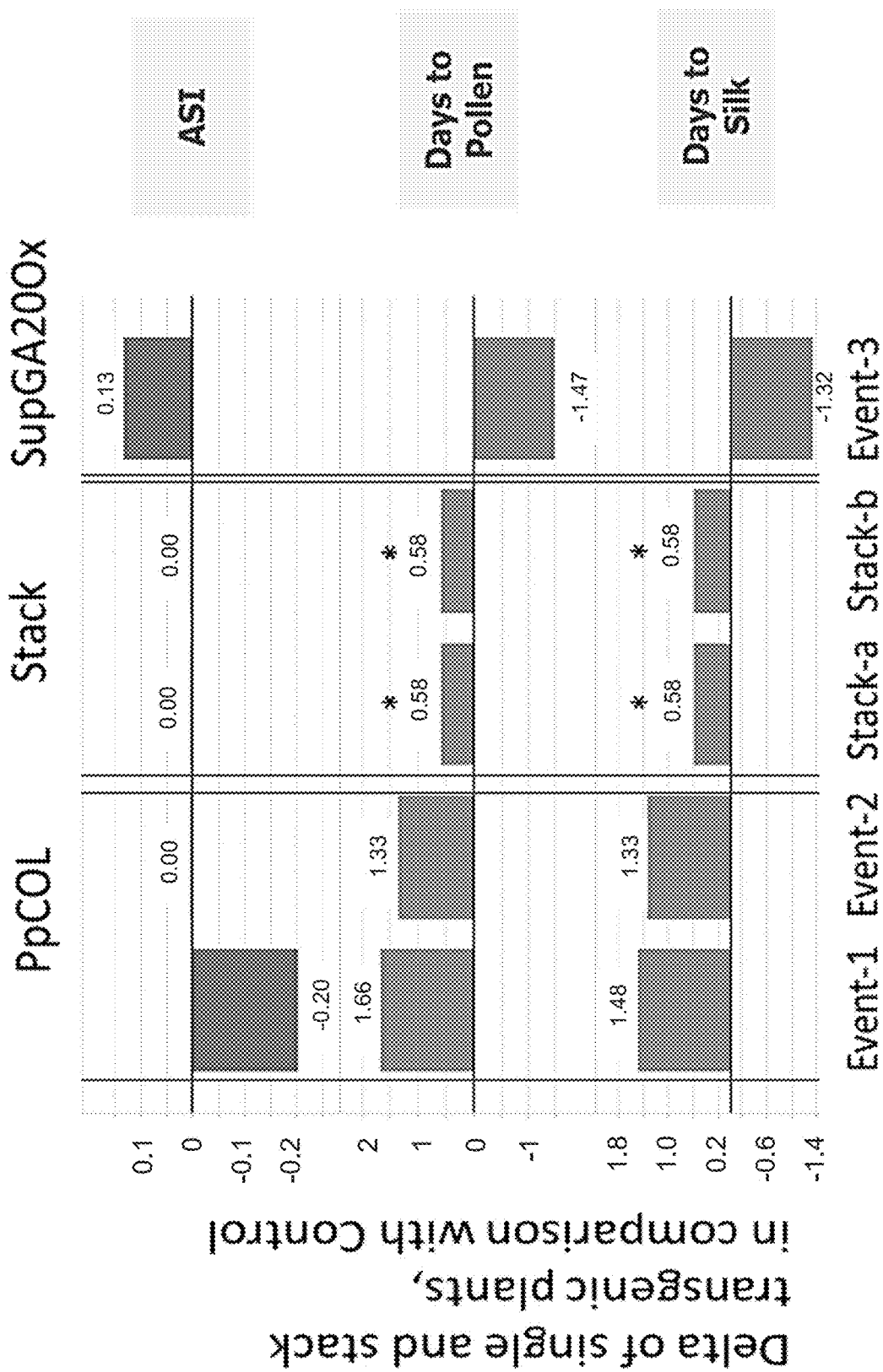
FIG. 7 shows days to 50% pollen shedding, days to 50% visible silk, and anthesis-silking interval (ASI) measurements for GA20Ox_SUP/PpCOL stack plants in one growing season relative to control plants.

The anthesis-silking interval (ASI), number of days to pollen shed, and number of days to silking of GA20Ox_SUP single plants (one event), PpCOL single plants (two events), and GA20Ox_SUP/PpCOL stack plants (two event combinations) were measured and compared to control plants. The results are shown in FIG. 7 as the difference (in days) in ASI, days to pollen, or days to silk, for each of the single and stack plants relative to control plants. The bars with an asterisk (*) are indicative of a statistically significant difference relative to the non-transgenic control plants (p-value ≤0.2).

As shown in FIG. 7, the PpCOL single plants take more days to pollen and more days to silk than control plants, and the GA20Ox_SUP single plants take fewer days to pollen and silk relative to control plants (although the differences in both cases are relatively small). However, the timing for visible silking and pollen shed for GA20Ox_SUP/PpCOL stack plants was more similar or closer to that of control plants as compared to the GA20Ox_SUP single and PpCOL single plants, with a relatively neutral ASI value delta (relative to control plants) than the GA20Ox_SUP single plants.

Example 10. Enhanced Ear Traits in the GA20Ox_SUP/PpCOL Stack Plants

Ear traits including ear area, ear volume, ear diameter, ear length, kernels per ear, and single kernel weight were measured in a single growing season for GA20Ox_SUP single, PpCOL single, and GA20Ox_SUP/PpCOL stack plants, in addition to control plants.

Figure 8:
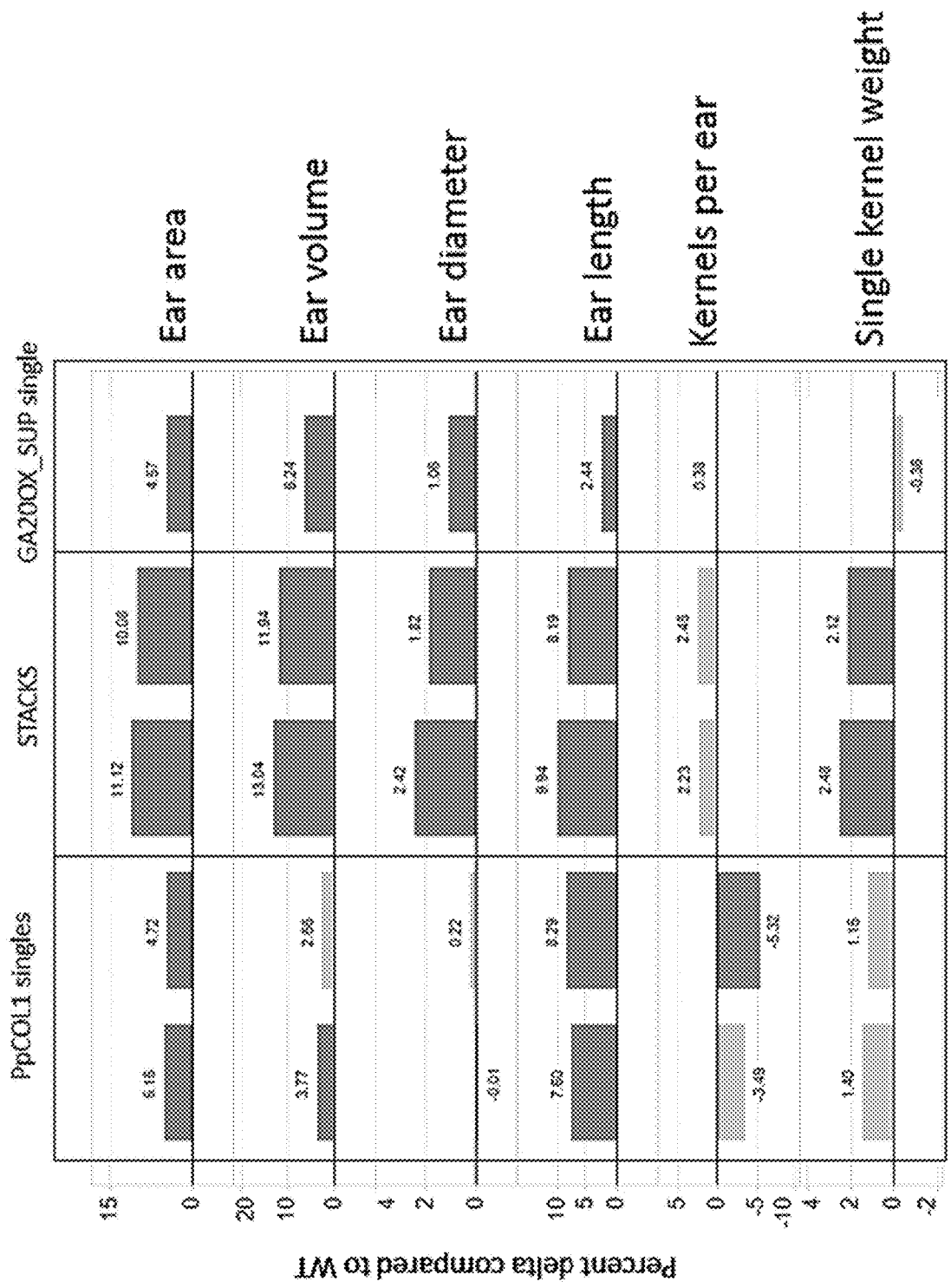
FIG. 8 shows ear traits of GA20Ox_SUP/PpCOL vector stack plants across two transformation events including ear area, ear volume, ear diameter, ear length, kernels per ear, and single kernel weight, relative to control plants.

FIG. 8 provides the ear trait results form this experiment as the difference (delta) of these traits for PpCOL single plants (two events), GA20OX_SUP single plants (one event), and GA20Ox_SUP/PpCOL breeding stack plants (two event combinations), relative to control plants (not containing the transgenes), with each bar indicating one transformation event (single) or event combination (stack). Dark gray bars in FIG. 8 are indicative of significantly positive or negative changes (p-value ≤0.2), and light gray bars are indicative of numerically positive or negative changes, all compared to control plants not containing the transgenes.

As shown in FIG. 8, PpCOL single events demonstrated statistically significant improved or increased ear area, ear volume (one event), and ear length, with a numerically positive increase in single kernel weight, relative to control plants, and a potential negative effect on the number of kernels per ear, relative to control plants. The GA20Ox_SUP single plants showed a statistically significant increased ear area, ear volume, ear diameter, and ear length, relative to control plants. However, GA20Ox_SUP/PpCOL stack plants demonstrated a statistically significant increase in ear area, ear volume, ear diameter, ear length, and single kernel weight, relative to control plants. GA20Ox_SUP/PpCOL stack plants also showed a numerical increase in kernels per ear, relative to control plants. Moreover, the average increase in ear area, ear volume, ear diameter, ear length, kernels per ear, and single kernel weight of the GA20Ox_SUP/PpCOL stack plants relative to control plants, was greater than that of the PpCOL single or GA20Ox_SUP single plants.

These results demonstrate that GA20Ox_SUP/PpCOL stack plants have enhanced ear traits, such as increased ear area, ear volume, ear diameter, ear length, kernels per ear, and single kernel weight, compared to control plants, PpCOL single plants, and/or GA20Ox_SUP single plants.

Example 11. Increased Grain Yield Estimate in the GA20Ox_SUP/PpCOL Stack Plants

Grain yield estimate was measured for GA20Ox_SUP single, PpCOL single, and GA20Ox_SUP/PpCOL stack plants, in addition to control plants.

Figure 9:
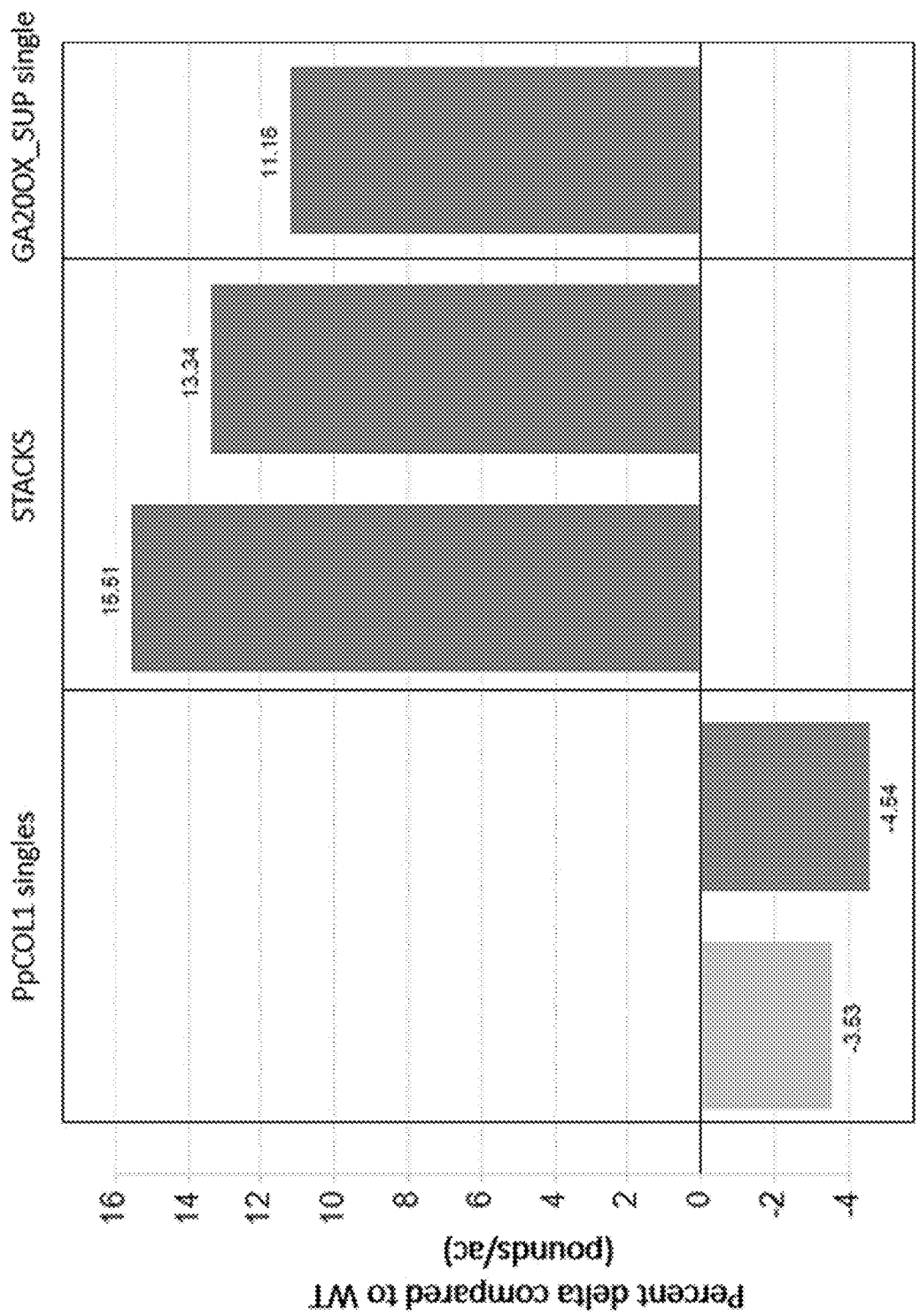
FIG. 9 shows the grain yield estimate of GA20Ox_SUP/PpCOL vector stack plants across two transformation events relative to control plants.

Grain yield estimate was measured (pounds/acre) for GA20OX_SUP single plants (one event), PpCOL single plants (two events), and GA20Ox_SUP/PpCOL stack plants (two event combinations) grown in a single growing season, with each bar indicating one transformation event or event combination. Results are shown in FIG. 9 as a percentage difference in grain yield estimate compared to wildtype control plants. Dark gray bars in FIG. 9 are indicative of statistically significant changes (p-value ≤0.2), and light gray bars are indicative of numerically positive or negative changes, all compared to wildtype control plants.

As shown in FIG. 9, while PpCOL single plants for at least one event demonstrated a negative grain yield estimate in this experiment, relative to control plants, GA20Ox_SUP single plants showed an increased grain yield estimate, relative to control plants. GA20Ox_SUP/PpCOL stack plants demonstrated a statistically significant increase in grain yield estimate, relative to control plants, with an average increase that was greater than that of the PpCOL single or GA20Ox_SUP single plants.

These results indicate that GA20Ox_SUP/PpCOL stack plants have enhanced grain yield estimate, compared to control plants, PpCOL single plants, and/or GA20Ox_SUP single plants.

Example 12. Enhanced Ear Traits in the GA20Ox_SUP/PpCOL Stack Plants

Ear traits were measured with GA20Ox_SUP single, PpCOL single, and GA20Ox_SUP/PpCOL stack plants. Ear traits including ear area, ear volume, ear length, kernels per ear, and single kernel weight were measured in two breeding stack event combinations of the GA20Ox_SUP/PpCOL stack plants grown in a single growing season, with each bar representing one transformation event combination. Dark gray bars in FIG. 10 are indicative of statistically significant positive changes (p-value ≤0.2), and light gray bars are indicative of numerically positive or negative changes, as compared to GA20Ox_SUP single or PpCOL single plants.

Figure 10:
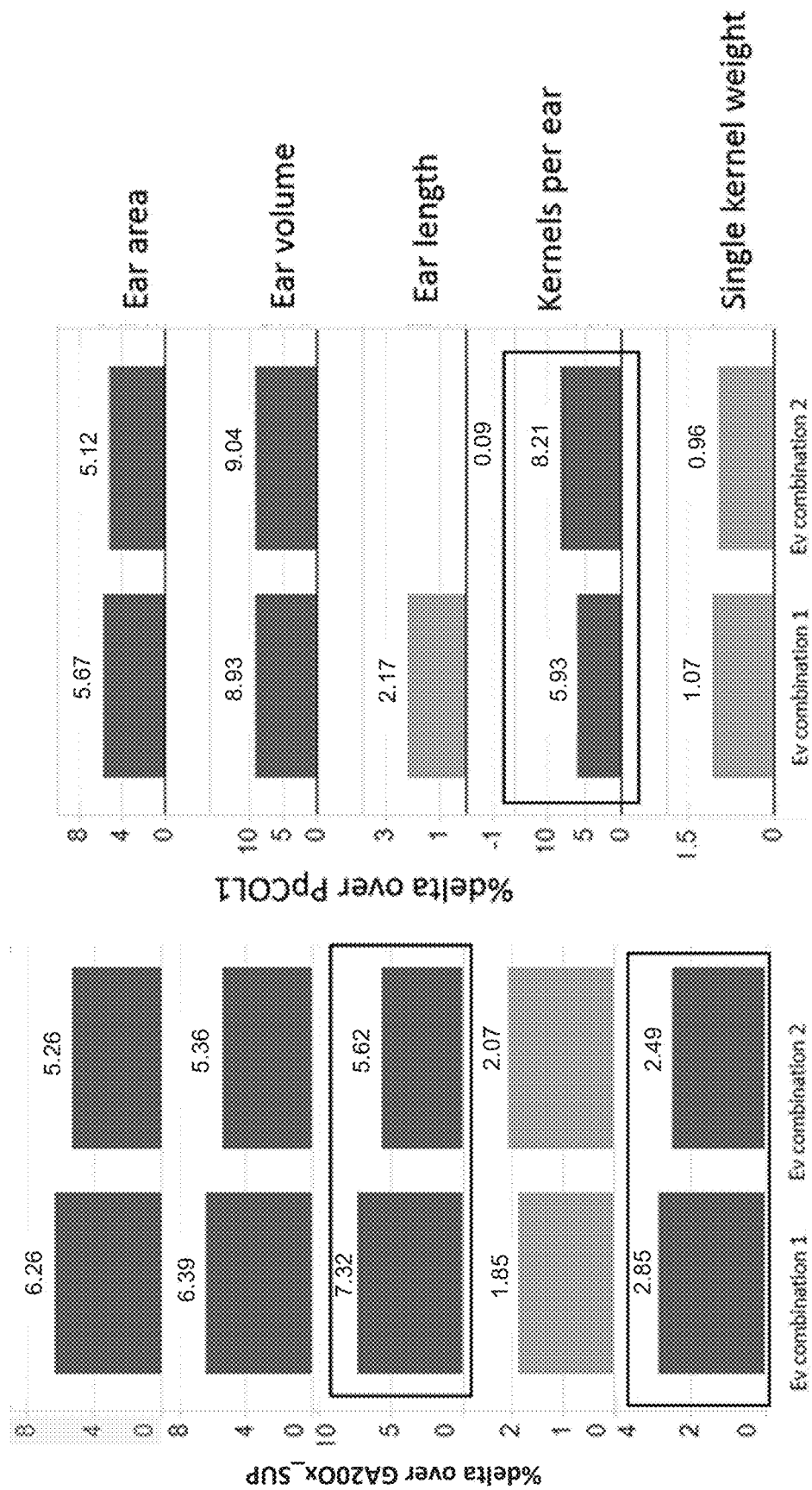
FIG. 10 shows ear traits of GA20Ox_SUP/PpCOL vector stack plants across two transformation events including ear area, ear volume, ear length, kernels per ear, and single kernel weight, relative to GA20Ox_SUP single or PpCOL single plants.

As shown in FIG. 10, GA20Ox_SUP/PpCOL stack plants demonstrated a statistically significant increase in ear area, ear volume, ear length, and single kernel weight, and a numerical increase in kernels per ear, relative to GA20Ox_SUP single plants. In addition, GA20Ox_SUP/PpCOL stack plants showed a statistically significant increase in ear area, ear volume, and kernels per ear, and a numerical increase in ear length and single kernel weight, relative to PpCOL single plants.

These results indicate that GA20Ox_SUP/PpCOL stack plants have enhanced ear traits, such as increased ear area, ear volume, ear length, kernels per ear, and single kernel weight, compared to PpCOL single plants and/or GA20Ox_SUP single plants.

Example 13. Generation of GA20Ox_SUP/PpCOL Vector Stack Plants Using a Single Vector Single constructs and vectors were created via molecular cloning having an expression cassette comprising a DNA sequence encoding a miRNA that targets the GA20 oxidase_3 and GA20 oxidase_5 genes in corn plants and another expression cassette comprising a DNA sequence encoding a PpCOL polypeptide. A first vector (Vector 1) was constructed comprising in order a gene sequence encoding a PpCOL polypeptide (SEQ ID NO: 169) and a miRNA-encoding DNA sequence (SEQ ID NO: 39) encoding a miRNA having a targeting sequence (SEQ ID NO: 40) for the GA20 oxidase_3 and GA20 oxidase_5 genes, wherein the two coding sequences are each operably linked to a promoter and a terminator sequence and are separated from each other by an intergenic sequence. A second vector (Vector 2) was constructed comprising in order a miRNA-encoding DNA sequence (SEQ ID NO: 39) encoding a miRNA having a targeting sequence (SEQ ID NO: 40) for the GA20 oxidase_3 and GA20 oxidase_5 genes, and a DNA sequence encoding a PpCOL polypeptide (SEQ ID NO: 169), wherein the two coding sequences are each operably linked to a promoter and a terminator sequence and are separated from each other by an intergenic sequence. The order of elements for each expression cassette is as provided above in Example 1.

Corn plants were transformed via *Agrobacterium*-mediated transformation with each of Vector 1 and Vector 2 to create transgenic corn plants. The transgenic corn plants containing a transformation event from Vector 1 or Vector 2 were then crossed as females to different male corn lines to create progeny plants comprising, from the female parent, the PpCOL transgene and the miRNA-encoding DNA sequence for GA20 oxidase suppression. The resulting stacked transgenic progeny plants are herein referred to as GA20Ox_SUP/PpCOL vector stack plants, as opposed to breeding or crossing stack plants where the transgenes are from different parents and are brought together in progeny plants by crossing the parents together. Thus, vector stacks will comprise a single event, whereas breeding or crossing stack plants will comprise a combination of two events in the case of a two-transgene stack. Vector 1 and Vector 2 differ in their intergenic regions and the arrangement order of the PpCOL-expression cassette and the GA20Ox3/5-miRNA cassette, although the cassettes themselves are the same.

Example 14. Increased Yield of the GA20Ox_SUP/PpCOL Vector Stack Plants Compared to Control Transgenic corn plants containing Vector 1 or Vector 2 were crossed as a female parent with two male tester corn lines ("Tester 1" and "Tester 2") to produce progeny GA20Ox_SUP/PpCOL vector stack plants. Four transformation events for each vector construct were tested for broad acre yield (BAY).

Figure 11A:
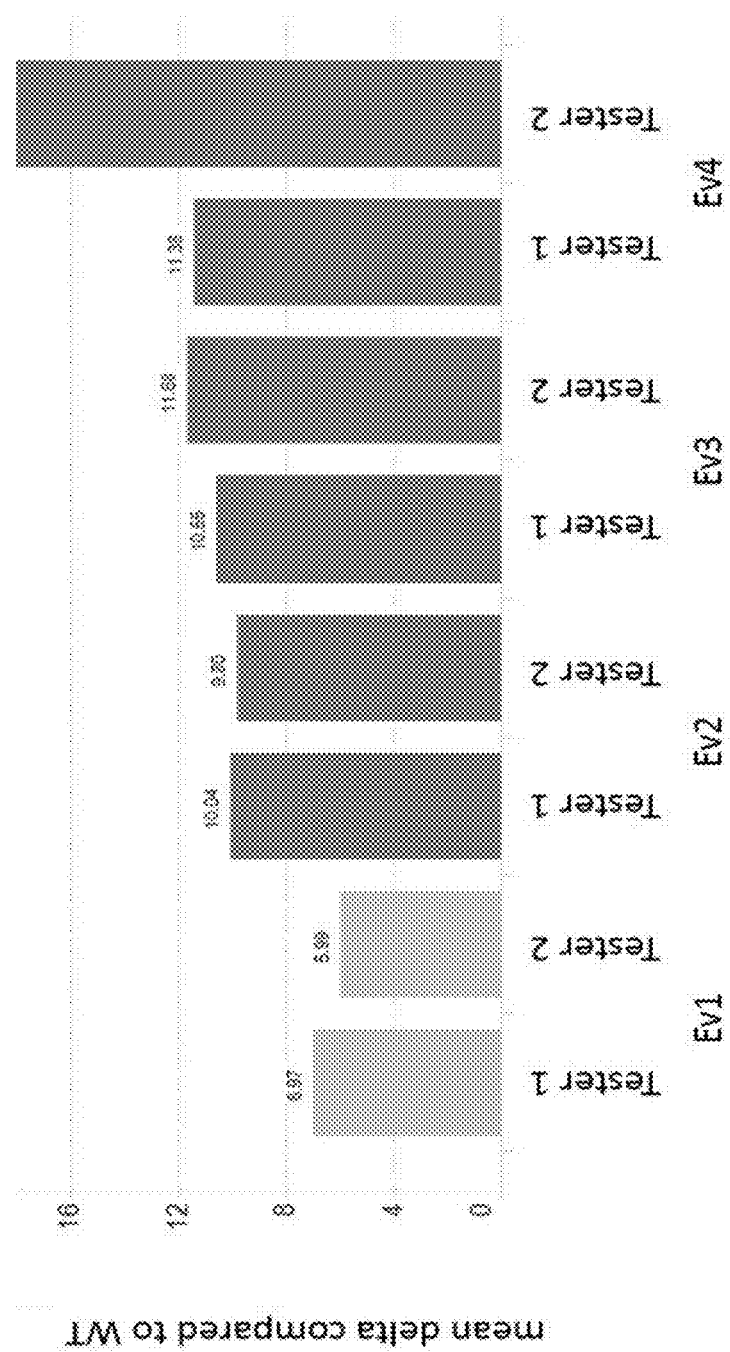
FIGS. 11A and 11B show the broad acreage yield of _ GA20Ox_SUP/PpCOL vector stack plants for two different vectors, respectively, across four transformation events for each vector and two testers relative to control plants.
Figure 11B:
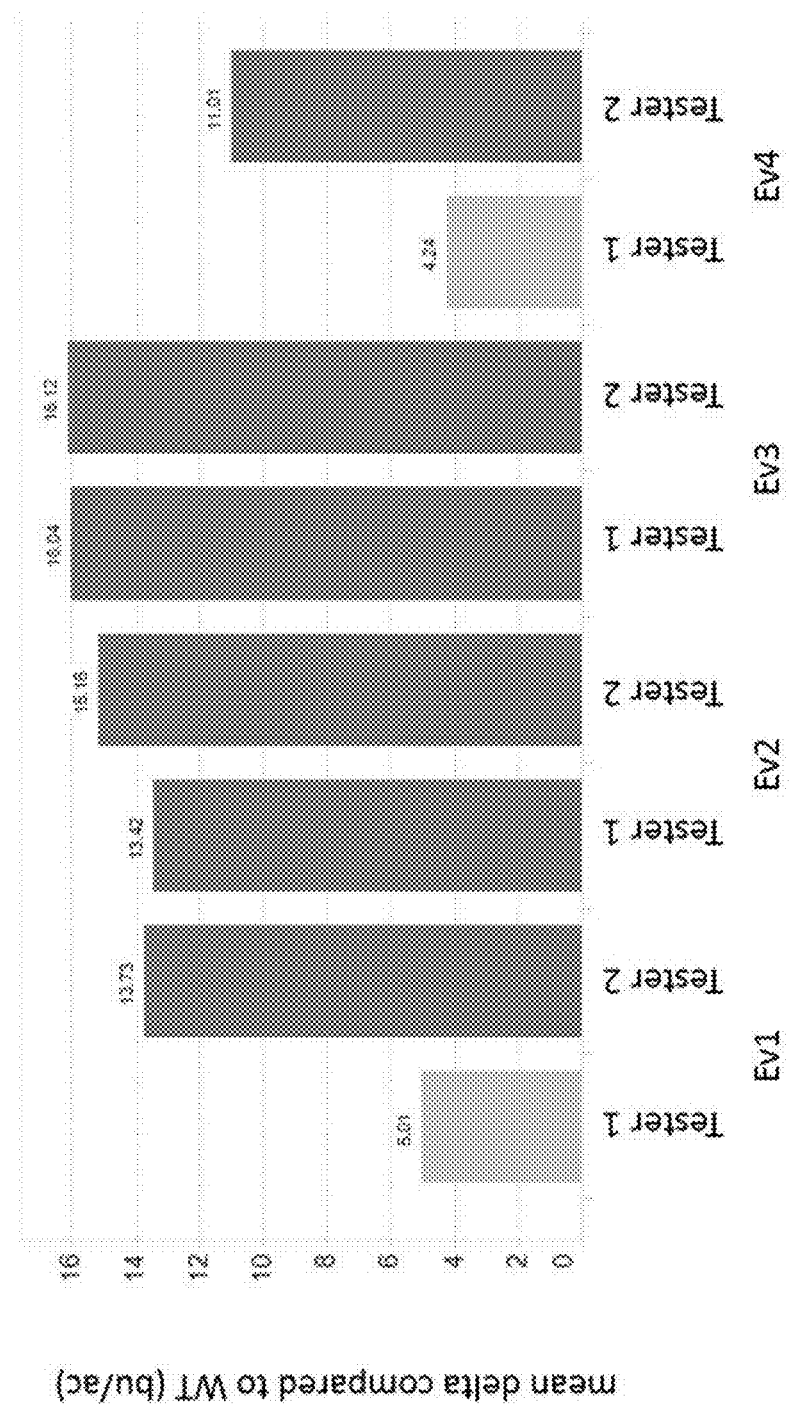

FIG. 11A shows BAY in one growing season across 15 locations from four events of GA20Ox_SUP/PpCOL vector stack plants containing a transformation event from Vector 1. FIG. 11B shows BAY in one growing season across 15 locations from four events of GA20Ox_SUP/PpCOL vector stack plants containing a transformation event from Vector 2. Results are shown as the mean difference in bushels/acre between the BAY of GA20Ox_SUP/PpCOL vector stack plants relative to wild-type control plants. Each bar in FIG. 11 represents a single vector stack transformation event crossed with either "Tester 1" or "Tester 2" male corn line. Dark gray bars in FIGS. 11A and 11B are indicative of statistically significant positive changes (p-value ≤0.1), and light gray bars are indicative of numerically positive changes.

As shown in FIG. 11A, three out of four events of GA20Ox_SUP/PpCOL vector stack plants containing a transformation event from Vector 1 showed statistically significant increase in BAY relative to wildtype control plants, and one event of GA20Ox_SUP/PpCOL vector stack plants containing a transformation event from Vector 1 showed numerical increase in BAY relative to wildtype control plants. As shown in FIG. 11B, two out of four events of GA20Ox_SUP/PpCOL vector stack plants containing a transformation event from Vector 2 showed statistically significant increase in BAY relative to wildtype control plants across both testers, and the other two events of GA20Ox_SUP/PpCOL vector stack plants transformed with Vector 2 showed statistically significant increase in BAY for one of the testers and a numerical increase in BAY for the other tester.

Figure 12:
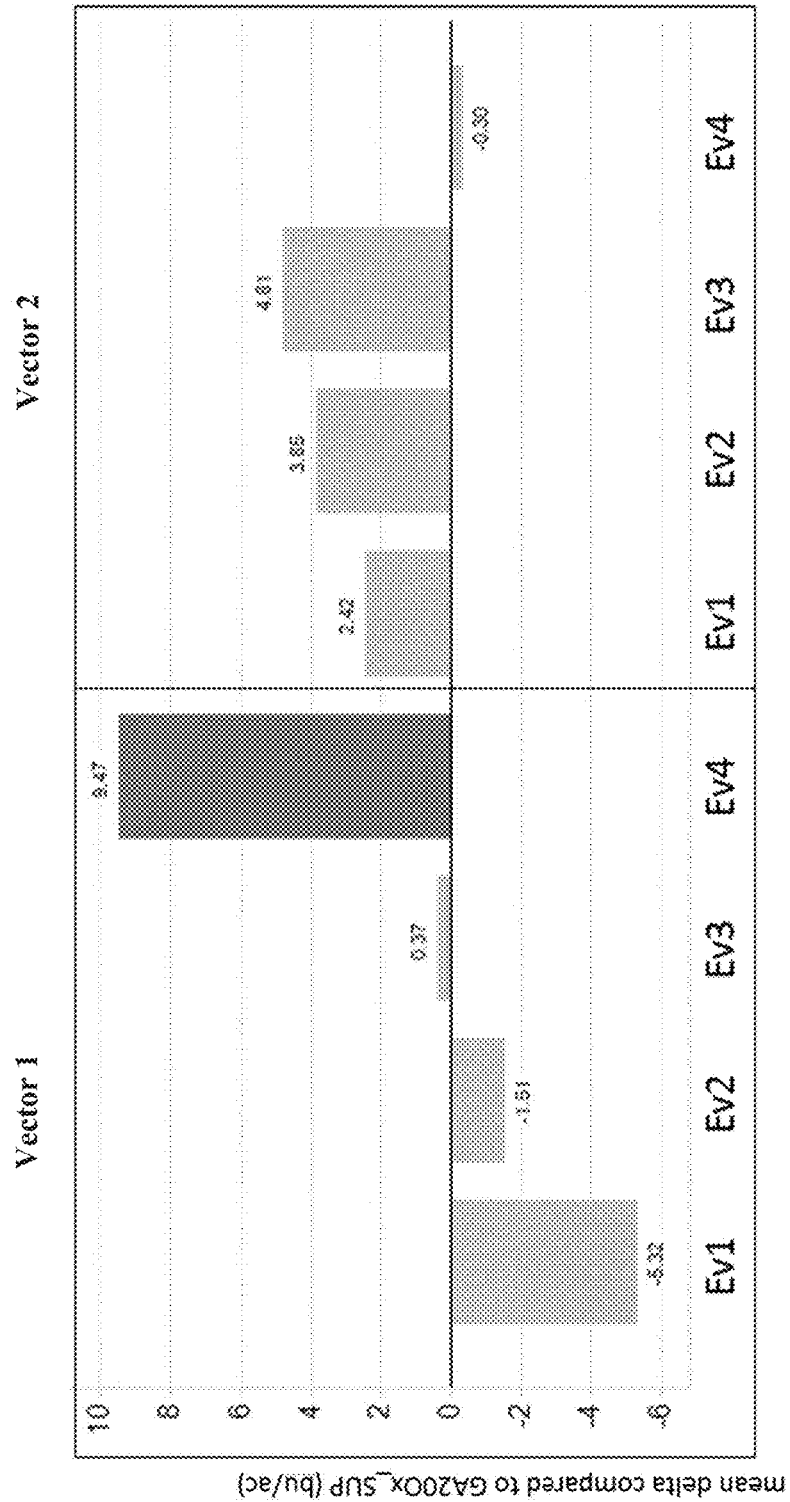
FIG. 12 shows the broad acreage yield of _ GA20Ox_SUP/PpCOL vector stack plants for two different vectors across four transformation events relative to GA20Ox_SUP single plants.

Example 15. Increased Yield of the GA20Ox_SUP/PpCOL Vector Stack Plants Compared to the GA20Ox_SUP Single FIG. 12 shows BAY in one growing season across 15 locations for four events of GA20Ox_SUP/PpCOL vector stack plants containing Vector 1 or Vector 2. BAY results are shown as the mean difference in bushels/acre between GA20Ox_SUP/PpCOL vector stack plants and GA20Ox_SUP single plants. Each bar in FIG. 12 represents a single transformation event. Dark gray bars in FIG. 12 are indicative of statistically significant positive changes (p-value ≤0.1), and light gray bars are indicative of numerically positive or negative changes.

As shown in FIG. 12, one out of four events of GA20Ox_SUP/PpCOL vector stack plants containing a transformation event from Vector 1 showed a statistically significant increase in BAY relative to GA20Ox_SUP single plants; and three out of four events of GA20Ox_SUP/PpCOL vector stack plants containing a transformation event from Vector 2 showed a numerical increase in BAY relative to GA20Ox_SUP single plants.

Figure 13:
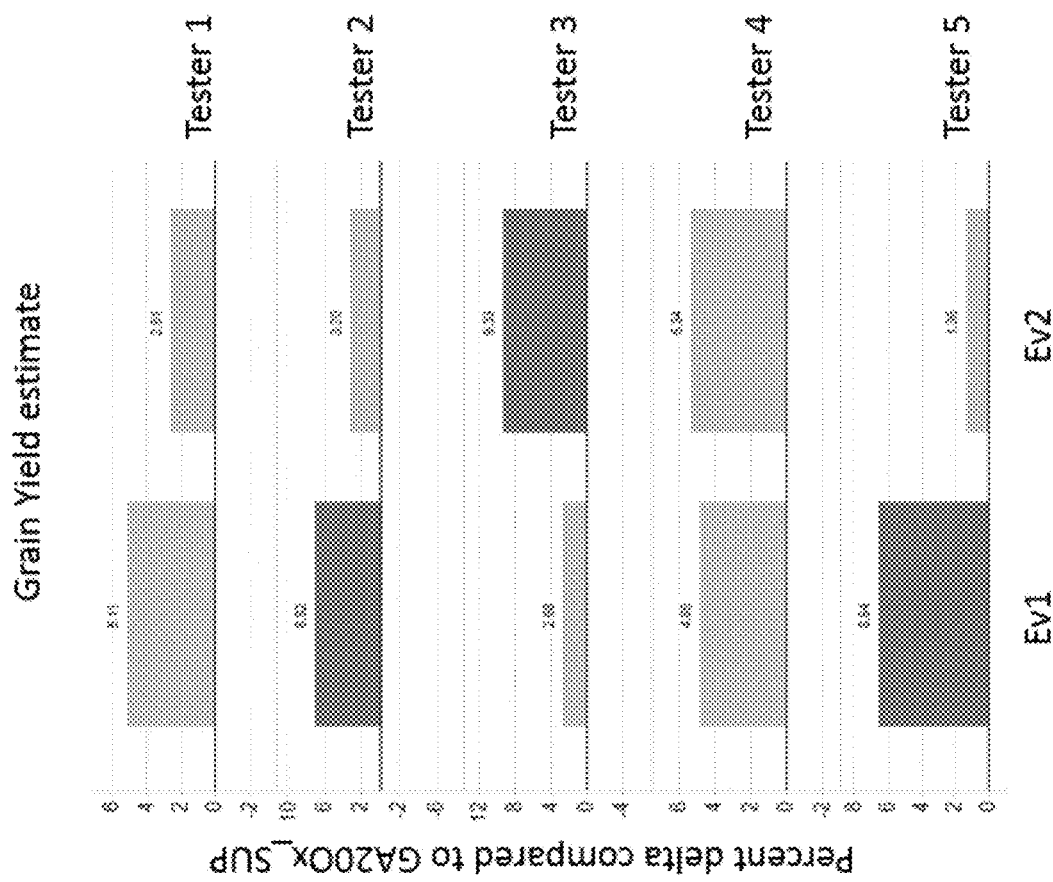
FIG. 13 shows the grain yield estimate of GA20Ox_SUP/PpCOL vector stack plants across two transformation events and five testers relative to GA20Ox_SUP single plants.

Example 16. Increased Grain Yield Estimate of the GA20Ox_SUP/PpCOL Vector Stack Plants Compared to the GA20Ox_SUP Single Female corn plants with one of two GA20Ox_SUP/PpCOL vector stack events made by transformation with Vector 2 were crossed with five different male tester corn lines ("Tester 1" to "Tester 5") to create transgenic GA20Ox_SUP/PpCOL vector stack progeny plants. FIG. 13 shows the measured grain yield estimate of GA20Ox_SUP/PpCOL vector stack plants from each of the two transformation events. Results are shown as the percentage difference between the grain yield estimate of the GA20Ox_SUP/PpCOL vector stack plants and that of GA20Ox_SUP single plants. Each bar in FIG. 13 is for a single transformation event. Dark gray bars in FIG. 13 are indicative of statistically significant positive changes (p-value ≤0.2), and light gray bars are indicative of numerically positive changes.

As shown in FIG. 13, progeny of female corn plants comprising one event of the GA20Ox_SUP/PpCOL vector stack (Event 1) showed statistically significant increases in grain yield estimate relative to GA20Ox_SUP single plants when crossed to two out of five male testers, and numerical increases in grain yield estimate relative to GA20Ox_SUP single plants when crossed to the other three male tester lines.

As further shown in FIG. 13, progeny of female corn plants comprising another event of the GA20Ox_SUP/PpCOL vector stack (Event 2) showed a statistically significant increase in grain yield estimate relative to GA20Ox_SUP single plants when crossed to one of five male testers, and numerical increases in grain yield estimate relative to GA20Ox_SUP single plants when crossed to the other four male testers.

Figure 14:
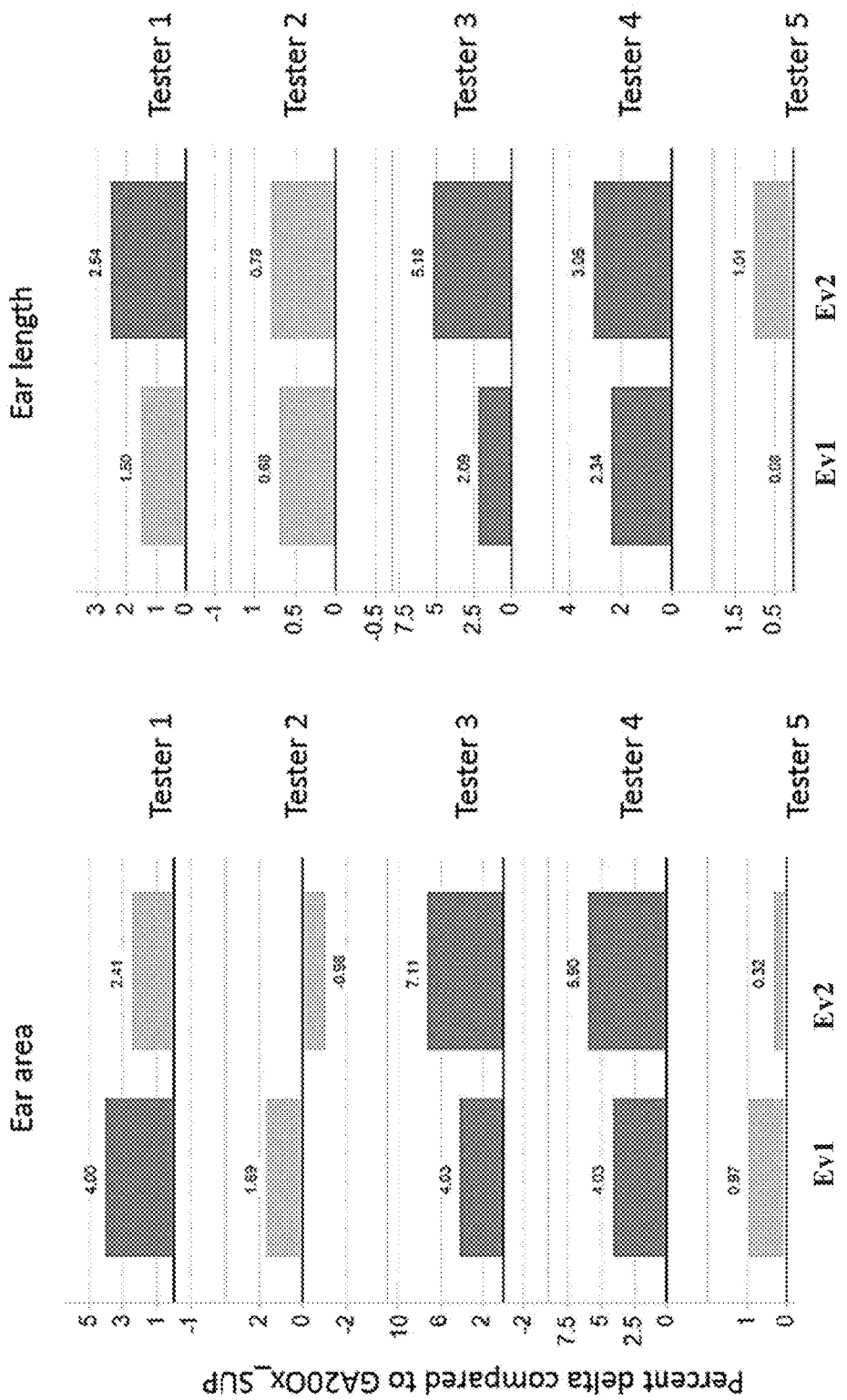
FIG. 14 shows ear area and ear length traits of GA20Ox_SUP/PpCOL vector stack plants across two transformation events and five testers relative to GA20Ox_SUP single plants.

Example 17. Enhanced Ear Area and Ear Length of the GA20Ox_SUP/PpCOL Vector Stack Plants Compared to the GA20Ox_SUP Single Female corn plants with one of two GA20Ox_SUP/PpCOL vector stack events made by transformation with Vector 2 were crossed with five different male tester corn lines ("Tester 1" to "Tester 5") to create transgenic GA20Ox_SUP/PpCOL vector stack progeny plants. FIG. 14 shows ear area and ear length traits of GA20Ox_SUP/PpCOL vector stack plants from each of two transformation events. Results are shown as the percentage difference between the ear area or ear length of the GA20Ox_SUP/PpCOL vector stack plants and that of GA20Ox_SUP single plants. Each bar in FIG. 14 is for a single transformation event. Dark gray bars in FIG. 14 are indicative of statistically significant positive changes (p-value ≤0.2), and light gray bars are indicative of numerically positive or negative changes.

As shown in the left panel of FIG. 14, progeny of female corn plants comprising one of the GA20Ox_SUP/PpCOL vector stack events (Event 1) showed statistically significant increases in ear area relative to GA20Ox_SUP single plants when crossed to three out of five male tester lines, and progeny of female corn plants comprising Event 1 of the GA20Ox_SUP/PpCOL vector stack showed numerical increases in ear area relative to GA20Ox_SUP single plants when crossed to the other two male tester lines. In addition, progeny of female corn plants comprising the other GA20Ox_SUP/PpCOL vector stack event (Event 2) showed statistically significant increases in ear area relative to GA20Ox_SUP single plants when crossed to two out of five male tester lines; and progeny of female corn plants comprising Event 2 of the GA20Ox_SUP/PpCOL vector stack showed numerical increase or decrease in ear area relative to GA20Ox_SUP single plants when crossed to the other three male tester lines.

As further shown in the right panel FIG. 14, progeny of female corn plants comprising one of the GA20Ox_SUP/PpCOL vector stack events (Event 1) showed a statistically significant increase in ear length relative to GA20Ox_SUP single plants when crossed to one out of five male tester lines, and progeny of female corn plants comprising Event 1 of the GA20Ox_SUP/PpCOL vector stack showed numerical increases in ear length relative to GA20Ox_SUP single plants when crossed to the other three male tester lines. In addition, progeny of female corn plants comprising the other GA20Ox_SUP/PpCOL vector stack event (Event 2) showed statistically significant increases in ear length relative to GA20Ox_SUP single plants when crossed to three out of five male tester lines, and progeny of female corn plants comprising Event 2 of the GA20Ox_SUP/PpCOL vector stack showed numerical increases in ear length relative to GA20Ox_SUP single plants when crossed to the other two male tester lines.

Figure 15:
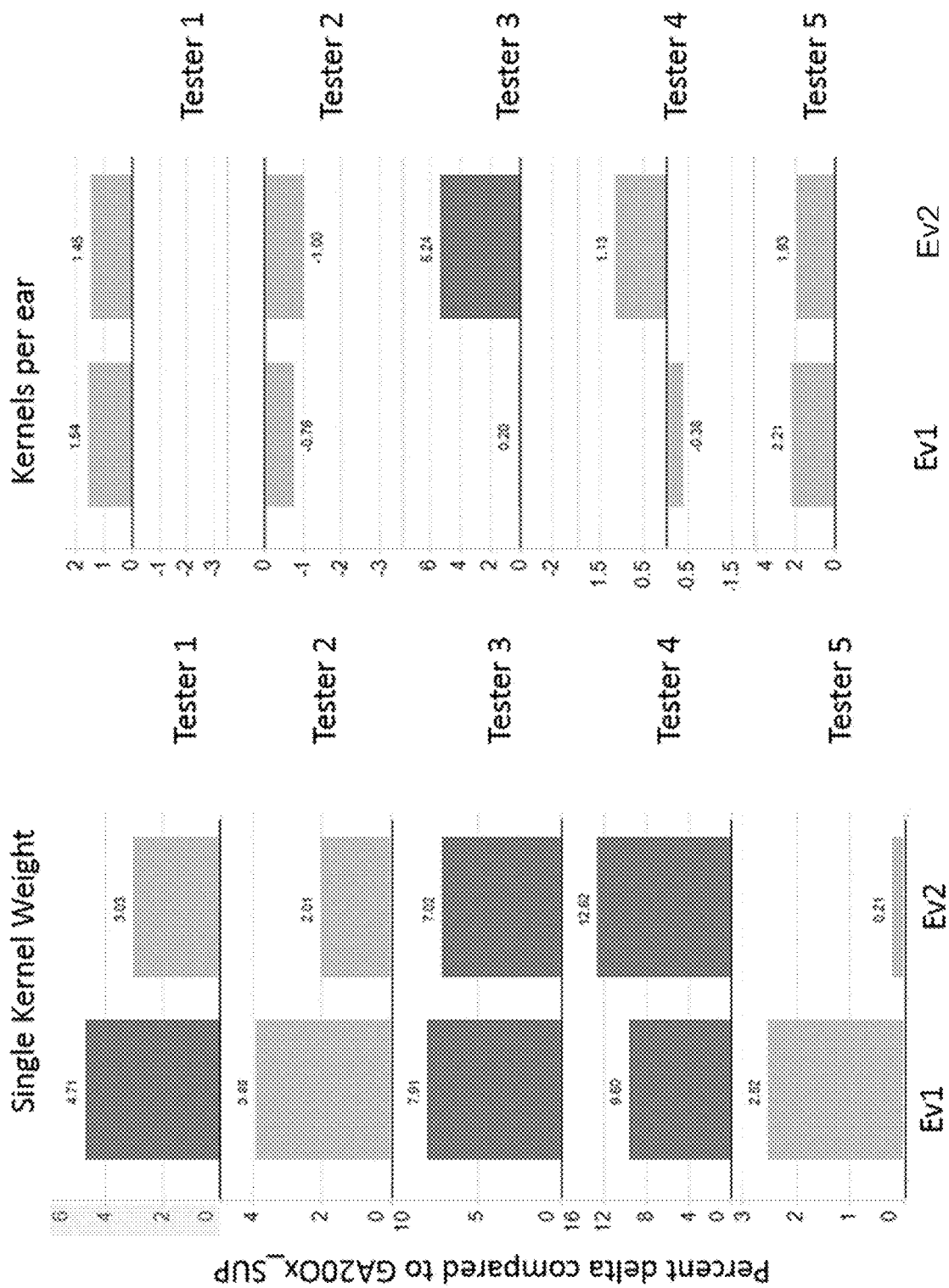
FIG. 15 shows single kernel weight and kernels per ear traits of GA20Ox_SUP/PpCOL vector stack plants across two transformation events and five testers relative to GA20Ox_SUP single plants.

Example 18. Enhanced Single Kernel Weight and Kernels Per Ear of the GA20Ox_SUP/PpCOL Vector Stack Plants Compared to GA20Ox_SUP Single Female corn plants with one of two GA20Ox_SUP/PpCOL vector stack events of corn plants made by transformation with Vector 2 were crossed with five different male tester corn lines ("Tester 1" to "Tester 5") to create transgenic GA20Ox_SUP/PpCOL vector stack progeny plants. FIG. 15 shows single kernel weight and kernels per ear of GA20Ox_SUP/PpCOL vector stack plants from each of two transformation events. Results are shown as the percentage difference between the single kernel weight or kernels per ear of the GA20Ox_SUP/PpCOL vector stack plants and that of GA20Ox_SUP single plants. Each bar in FIG. 15 is for a single transformation event. Dark gray bars in FIG. 15 are indicative of statistically significant positive changes (p-value ≤0.2), and light gray bars are indicative of numerically positive or negative changes.

As shown in the left panel of FIG. 15, progeny of female corn plants comprising one of the GA20Ox_SUP/PpCOL vector stack events (Event 1) showed statistically significant increases in single kernel weight relative to GA20Ox_SUP single plants when crossed to three out of five male tester lines, and progeny of female corn plants comprising Event 1 of the GA20Ox_SUP/PpCOL vector stack showed numerical increases in single kernel weight relative to GA20Ox_SUP single plants when crossed to the other two male tester lines. In addition, progeny of female corn plants comprising the other GA20Ox_SUP/PpCOL vector stack event (Event 2) showed statistically significant increase in single kernel weight relative to GA20Ox_SUP single plants when crossed to two out of five male tester lines, and progeny of female corn plants comprising Event 2 of the GA20Ox_SUP/PpCOL vector stack plants from Event 2 showed numerical increases in single kernel weight relative to GA20Ox_SUP single plants when crossed to the other three male tester lines.

As further shown in the right panel FIG. 15, progeny of female corn plants comprising one of the GA20Ox_SUP/PpCOL vector stack events (Event 1) showed numerical increases in kernels per ear relative to GA20Ox_SUP single plants when crossed to two or three out of five male tester lines, although progeny of female corn plants comprising Event 1 of the GA20Ox_SUP/PpCOL vector stack showed numerical decreases in kernels per ear relative to GA20Ox_SUP single plants when crossed to two other male tester lines. In addition, progeny of female corn plants comprising the other GA20Ox_SUP/PpCOL vector stack event (Event 2) showed a statistically significant increase in kernels per ear relative to GA20Ox_SUP single plants when crossed to one out of five male tester lines, and progeny of female corn plants comprising Event 2 of GA20Ox_SUP/PpCOL vector stack showed numerical increases in kernels per ear relative to GA20Ox_SUP single plants when crossed to two other male tester lines, although progeny of female corn plants comprising Event 2 of GA20Ox_SUP/PpCOL vector stack showed a numerical decrease in kernels per ear relative to GA20Ox_SUP single plants when crossed to another male tester line.

Having described the present disclosure in detail, it will be apparent that modifications, variations, and equivalent aspects are possible without departing from the spirit and scope of the present disclosure as described herein and in the appended claims. Furthermore, it should be appreciated that all examples in the present disclosure are provided as non-limiting examples.

SEQUENCE LISTING (452 sequences)

SEQ ID NO: 1 - DNA, 1741 bp, Zea mays
gacggtagttttcatctaaagtttattcttcgtcacatgggatggccgtttgcttgtttgttgcttccgggaggcggtggtgaattgaagcagatcgacaagcatggctgcccactggtctcgatcgatcggcctgccatgccatgccatgccactagagtccgtcctgactggccgcccgttcccccgtataaaaaggcaggcaggcaggcagagcggggacgagcaagcaagcagttgcagttgcagcggcctcctcctctgcttcctccctcctcctcctcaccatggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtaggcatgctatttgggtatggaagatggtggatgtaagcaaacaaagccaaattaagcagagtaggttaattaaggttggctgatgatccatttagggaaggagctgatctccctgactccctcctccaattttctcaaccaaatttatatagtataataataataataaaatagcaagtaatagttgtatcgtattattattaattaatttattagctggtaggcaagtagtattaaataccatttgtagtacgatgggcgtatttctattttggcgttttgctctgtgttttttgacgtttcctttggatttggggggacctcagatcagctcggcct

SEQ ID NO: 2 - DNA, 1116 bp, Zea mays
atggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtag

SEQ ID NO: 3 - protein, 371 aa, Zea mays
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSIRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTSSNGGQHLLEKK

SEQ ID NO: 4 - DNA, 1517 bp, Zea mays
caggaataaaataagcctccgcccggcttcgttgcatccacgcacgcagcaagcgatcggatttcgccagcatggcggcggcggccgtggtgttcgacgccgaggcgctgagccgggaggagcacatcccggcgcagttcgtgtggcccaccgaggagcgggcgccggcgggcggcgtggaggaggtcgccatccccgtggtcgacctcggcgagttcctccgccgcggggtgctcccgcgcggcgtggcggaggcgtgcgagcgccacggcgtcttccaggtggtgaaccacggcgtgggcgccgcgctgctcgccgaggcctaccgctgttgcgacgccttttacgcgctcccgctcgcggacaagcagcgcgcgcagcgccggcacggggagaaccacggctacgccagcagcttcacgggccgcttccactgctgcctgccgtggaaggagacgctgtccttcaactgccccgccggtgccgggactgcgcgcgccgtcgtcggctacttcgtcgacgtcctcggcgaggactaccgccacatgggggaggtgtaccaggagtactgcgacgcgatgacgcgtctggcgctggacgtgacggaggtgctggcggcagcgctggggctggaccgcggcgcactgcgcggcttcttcgagggcggcgactccgtcatgcggctgaaccactacccggcgtgccggcagccgcacctgacgctggggacgggcccgcaccgggacccgacgtcgctgacgctgctgcaccaggacgacgtgggcgggctgcaggtgcgcgccggcggcgggccgtggcgcgcggtgcggccccgcgcggacgcgttcgtggtcaacattggcgacaccttcgccgcgctcaccgacgggcgtcacaccagctgcctgcaccgcgccgtggtgaccggcggcggctcccgccggtcgctcgccttcttcctcaacccgccgctggaccgcgtcgtccgcccgccgggcgcgctcctccaggagaacaagcaggcgggccgcccgcgcgcgttcccggacttcacgtggcgcgagttcctcgagttcacgcagaagcactaccggtcggacgcgggcaccatggacgccttcgtgtcgtggatcgcgggaggccgccgccaccatggcggacaggaggagggcaactgagatcgatgcatctctagctgtaggcagcagcgcagcagctaccaagaataatggccggcgacggagatgcagctacgacgcacaaataaattgagtgtttgtggtacaataaggacgaggacgatcaatggcgacctgtaaccggtgcagttttagttaatctttcatggcgatatggcattaaccaatcgttggtgtaaaatgcgtgcatgctttgcatgccaatgttggccatgtgatggcacagcgtgagtgtagctcacccaccgtgacaacgtgctaatttcgtgtggtcctagataccaaggtcgtctaatgaacttgatggattgatgattt

SEQ ID NO: 5 - DNA, 1107 bp, Zea mays
atggcggcggcggccgtggtgttcgacgccgaggcgctgagccgggaggagcacatcccggcgcagttcgtgtggcccaccgaggagcgggcgccggcgggcggcgtggaggaggtcgccatccccgtggtcgacctcggcgagttcctccgccgcggggtgctcccgcgcggcgtggcggaggcgtgcgagcgccacggcgtcttccaggtggtgaaccacggcgtgggcgccgcgctgctcgccgaggcctaccgctgttgcgacgccttttacgcgctcccgctcgcggacaagcagcgcgcgcagcgccggcacggggagaaccacggctacgccagcagcttcacgggccgcttccactgctgcctgccgtggaaggagacgctgtccttcaactgccccgccggtgccgggactgcgcgcgccgtcgtcggctacttcgtcgacgtcctcggcgaggactaccgccacatgggggaggtgtaccaggagtactgcgacgcgatgacgcgtctggcgctggacgtgacggaggtgctggcggcagcgctggggctggaccgcggcgcactgcgcggcttcttcgagggcggcgactccgtcatgcggctgaaccactacccggcgtgccggcagccgcacctgacgctggggacgggcccgcaccgggacccgacgtcgctgacgctgctgcaccaggacgacgtgggcgggctgcaggtgcgcgccggcggcgggccgtggcgcgcggtgcggccccgcgcggacgcgttcgtggtcaacattggcgacaccttcgccgcgctcaccgacgggcgtcacaccagctgcctgcaccgcgccgtggtgaccggcggcggctcccgccggtcgctcgccttcttcctcaacccgccgctggaccgcgtcgtccgcccgccgggcgcgctcctccaggagaacaagcaggcgggccgcccgcgcgcgttcccggacttcacgtggcgcgagttcctcgagttcacgcagaagcactaccggtcggacgcgggcaccatggacgccttcgtgtcgtggatcgcgggaggccgccgccaccatggcggacaggaggagggcaactga

SEQ ID NO: 6 - protein, 368 aa, Zea mays
MAAAAVVFDAEALSREEHIPAQFVWPTEERAPAGGVEEVAIPVVDLGEFLRRGVLPRGVAEACERHGVFQVVNHGVGAALLAEAYRCCDAFYALPLADKQRAQRRHGENHGYASSFTGRFHCCLPWKETLSFNCPAGAGTARAVVGYFVDVLGEDYRHMGEVYQEYCDAMTRLALDVTEVLAAALGLDRGALRGFFEGGDSVMRLNHYPACRQPHLTLGTGPHRDPTSLTLLHQDDVGGLQVRAGGGPWRAVRPRADAFVVNIGDTFAALTDGRHTSCLHRAVVTGGGSRRSLAFFLNPPLDRVVRPPGALLQENKQAGRPRAFPDFTWREFLEFTQKHYRSDAGTMDAFVSWIAGGRRHHGGQEEGN

SEQ ID NO: 7 - DNA, 1522 bp, Zea mays
gcacactcgcagctcgcacatctcatggtgtcctaagaacggcaagagccagctctgcctagcagcagcgcacagccacatccatggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaacgagccggccgtctctttcgccggggcccgcgcggggttcgcccacgtggtgatcaggtggcagacatgtggcccacgggccccgcgccgccttccccatttttggacgaccctactgctactactactagtgtacatatgcaaaaaaatacatatatatataggtactttctctaatatttttatatataagcaaggcggcctggtgttcttttctttgttttgtcgacaactgtttgatcccatcctatggacgatggatagttcaatgtttgtac

SEQ ID NO: 8 - DNA, 1161 bp, Zea mays
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatggcgctgtccaacgggcggtacaagagctgcctgcaccgcgcggtggtgaaccggcggcaggagcggcaatcgctggccttcttcctgtgcccgcgcgaggaccgggtggtgcgcccgccggccagcgccgcgccgcggcagtacccggacttcacctgggccgacctcatgcgcttcacgcagcgccactaccgcgccgacacccgcacgctggacgccttcacccgctggctctcccacggcccggcggcggcggctccctgcacctaa

SEQ ID NO: 9 - protein, 386 aa, Zea mays
MDASPTPPLPLRAPTPSIDLPAGKDRADAAANKAAAVFDLRREPKIPEPFLWPHEEARPTSAAELEVPVVDVGVLRNGDGAGLRRAAAQVAAACATHGFFQVCGHGVDAALGRAALDGASDFFRLPLAEKQRARRVPGTVSGYTSAHADRFASKLPWKETLSFGFHDGAAAPVVVDYFTGTLGQDFEPVGRVYQRYCEEMKELSLTIMELLELSLGVERGYYREFFEDSRSIMRCNYYPPCPVPERTLGTGPHCDPTALTILLQDDVGGLEVLVDGEWRPVRPVPGAMVINIGDTFMALSNGRYKSCLHRAVVNRRQERQSLAFFLCPREDRVVRPPASAAPRQYPDFTWADLMRFTQRHYRADTRTLDAFTRWLSHGPAAAAPCT

SEQ ID NO: 10 - DNA, 1457 bp, Zea mays
taatcacctcatcacaggtccccccagcctcactctcgcgccggctcaaggtacattgcgtgtcctagccaagacacgcagctcatctcagcctcacacgcacagcaagagcgaggcgtgattcgccatgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatgtgaatatgtaatatgatgagcactcctactttggtatgtttgggaataacagacttgtgttggtctggttcattatttgtaagaaaatcaaaaagagttagtagggcaggaggctaaccacagtcatgctgcaccacatccctggtggaaagctggccgggttacgcta

SEQ ID NO: 11 - DNA, 1116 bp, Zea mays
atgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtag

SEQ ID NO: 12 - protein, 371 aa, Zea mays
MGGLTMDQAFVQAPEHRPKPIVTEATGIPLIDLSPLAASGGAVDALAAEVGAASRDWGFFVVVGHGVPAETVARATEAQRAFFALPAERKAAVRRNEAEPLGYYESEHTKNVRDWKEVYDLVPREPPPPAAVADGELVFDNKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVRERGAPGVGELGEGEVLHALLLQPGDLHHGGAGGGAGEQGRSAQVRRLQLGRLLQHQEEQQLQEAQRGEHSDRAFQEEPRPRLTTATARIHAIAMSSSDSEHAMSSLASW

SEQ ID NO: 13 - DNA, 1733 bp, Zea mays
atgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctagcgagccgggccaaggccgtctctttcgccccacgtgcgcgcccagctgggcaggtggccagacacgcggcccgcgggccccgcgccgccttgccattttttgacgctggccctactgctgtgctactagtgtacatatgcaagagtacatatatatatatatatatacgtattttctatatattatatataaaagcaaggcggcccggtgcccttctcttgttttgtccacaactgtttgatcccattattctatggaccatggatacttcaatgtttgtactaagaccgtgaacgtgggattcttttccttcctctgtgttttttctgagaaaaattaaa

SEQ ID NO: 14 - DNA, 1392 bp, Zea mays
atgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggcgctgtcgaacgggaggtacaagagctgcctgcaccgcgcggtggtgaaccagcggcgggcgcggcggtcgctggccttcttcctgtgcccgcgcgaggaccgggtggtgcgcccgccggccagtgctgcgccgcggcgctacccggacttcacctgggccgacctcatgcgcttcacgcagcgccactaccgcgccgacacccgcacgctggacgccttcacccgctggctctcccacggcccggcccaggcggcggcgcctccctgcacctag

SEQ ID NO: 15 - protein, 463 aa, Zea mays
MRPRLPPNVPSLPSSLSLLANSLSSPVTNTPTRPDSFPAYLQLAHLMVSQERQEPAVPSSSSSSAKRAATSMDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYTSAHADRFAAKLPWKETLSFGYHDGAASPVVVDYFVGTLGQDFEPMGWVYQRYCEEMKELSLTIMELLELSLGVELRGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRRARRSLAFFLCPREDRVVRPPASAAPRRYPDFTWADLMRFTQRHYRADTRTLDAFTRWLSHGPAQAAAPPCT

SEQ ID NO: 16 - DNA, 1510 bp, Zea mays
aaagagcgcgcgacggcggcccctgggagagccatgcgagactggaggcggaaccgcgcacgacaccaagctgccgcgccggactgctgcacgcaagcgcagcgcaggaccgaccgacctccgtaggcacgcacggcgccggcggcatggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaagcgctgggggagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacaagtactacgccaagttctggagcaggaacctggaccaggagcactgcctcgagctcttcagaacctagcgaatcggatacggatggatggatacattacatacgcgccctctgtttttctccatgacgttagaagaacacgttctgcaatgtttgtccattcaaggtggtatcaatcaaggctgtggtcgttgcaattcttccgctccatatacatgattaaatgctttgaaagaaaaagaaaaaaaagaaacacaagtattatggcactactagtgtttttaggaacaaggaaagaggggttgcccctgctggctatatatattaaatataaataaaggtaaggctgtagacattggtgaataagagaaagtatttgagtttctctattgtcactccagaacagactcctttgcctcgat

SEQ ID NO: 17 - DNA, 1011 bp, Zea mays
atggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaggccaagctctactccgacgaccccgccaggaagatccggctgtccaccagcttcaacgtgcgcaaggagacggtgcacaactggcgcgactacctccgcctgcactgccatcccctcgacgagttcctgcccgattggccgtccaacccgcccgatttcaaggagaccatgggcacctactgcaaggaggtccgggagctcgggttcaggctgtacgccgcgatctcggagagcctgggcctagaggcgagctacatgaaggaagcgctgggggagcaggagcagcacatggcggtcaacttctacccgccgtgcccggagccggagctcacctacggcctcccggcgcacaccgaccccaacgcgctcaccatcctgctcatggacccggacgtcgccggcctgcaggtgctccacgccggccagtgggtcgccgtcaacccgcagcccggcgcgctcatcatcaacatcggcgaccagctgcaggcgctgagcaacgggcagtaccggagcgtgtggcaccgcgcggtggtgaactcggaccgggagcgcatgtccgtggcgtcgttcctgtgcccgtgcaaccacgtcgtgctcggccccgcgcggaagctcgtcaccgaggacaccccggccgtgtacaggaactacacgtacgacaagtactacgccaagttctggagcaggaacctggaccaggagcactgcctcgagctcttcagaacctag

SEQ ID NO: 18 - protein, 336 aa, Zea mays
MAEHLLSTAVHDTLPGSYVRPEPERPRLAEVVTGARIPVVDLGSPDRGAVVAAVGDACRSHGFFQVVNHGIHAALVAAVMAAGRGFFRLPPEEKAKLYSDDPARKIRLSTSFNVRKETVHNWRDYLRLHCHPLDEFLPDWPSNPPDFKETMGTYCKEVRELGFRLYAAISESLGLEASYMKEALGEQEQHMAVNFYPPCPEPELTYGLPAHTDPNALTILLMDPDVAGLQVLHAGQWVAVNPQPGALIINIGDQLQALSNGQYRSVWHRAVVNSDRERMSVASFLCPCNHVVLGPARKLVTEDTPAVYRNYTYDKYYAKFWSRNLDQEHCLELFRT

SEQ ID NO: 19 - DNA, 1387 bp, Zea mays
gttttctttttgaacgtaactgacagaagctatctgcctagctacggcgtgtcggttgcttgtctcaccaaagcagcgacatggaagcctgacagctcgtcgcgtcgcgccatttccacccaacaaagcggcggcgccagcacgcactgcttctgcttgtgcgtgctcctccgttccgggcacgcctctaaagtctatacagcctcgaatccatcccggccgccgctcctgggggatactacagcgagccgaagcggggatggcggagatccctgtgatcgacctgcgcgtcgccggctcggcggccgaggagtccgcgcggctgcgggccgcgtgcgagcgcctgggctgcttccgggtgaccggccacggcgtgccctcggtgctcctggcagagatgaaggccgccgtgcgcgcgctcttcgacctccccgacgacgccaagcgccgcaacgccgacgtcatcaccggcagcggctacgtcgcccccagcccgaccaacccgctctacgaggccttcgggctcctcgacgccgccgtgcccaccgacgtcgacgccttttgcgcgctcctcgacgcgccgcccaacatcagggagaccgtcaaggcctacgcggagaagatgcacgatgtgatcgttggcgtcgcccgcgagctggcgtctagcctggggctagtcgaggagcactcgttccaggactggccgtgccagttccgcatcaacaggtacaactacacgcgggagacggtgggctcctccggcgtgcagacccacacggactcgggcttcctcaccgtgctccatgaggacgagtgtgtcggcggcctcgaggtcctggacccgggcaccggcgagttcgtgcccgtggaccccgtcgcgggctcctttctcgtaaacatcggcgacgtcggcacggcgtggagcaacgggaggctgcacaacgtgaagcaccgggtgcggtgcgtcgcacccgtgccgcgcatctccatcgccatgttcctgctcgcacccaaggacgacagcgtgagcgcaccggcggcgttcgtggacgcggaccacccgcgcaggtacaaggtgttcaactacaacgactatcggaggctcagactgtccaccggcgagcacgcaggcgaggcgctcgcacggatggcggcgtgacgtggctggagctgcaaattggattggaagccgagacaagccgttagttatttaccatgcccgtgcgttcaccgcacacaatcatattcaaaagccataaaataaaaaataattttaatatcagtcaacatatggtttaaatatcatatggagtacaatattccgaatttttttttgtaatttagtctgtcttttgaaaaaaatgcacatctagacctccggatgact

SEQ ID NO: 20 - DNA, 900 bp, Zea mays
atggcggagatccctgtgatcgacctgcgcgtcgccggctcggcggccgaggagtccgcgcggctgcgggccgcgtgcgagcgcctgggctgcttccgggtgaccggccacggcgtgccctcggtgctcctggcagagatgaaggccgccgtgcgcgcgctcttcgacctccccgacgacgccaagcgccgcaacgccgacgtcatcaccggcagcggctacgtcgcccccagcccgaccaacccgctctacgaggccttcgggctcctcgacgccgccgtgcccaccgacgtcgacgccttttgcgcgctcctcgacgcgccgcccaacatcagggagaccgtcaaggcctacgcggagaagatgcacgatgtgatcgttggcgtcgcccgcgagctggcgtctagcctggggctagtcgaggagcactcgttccaggactggccgtgccagttccgcatcaacaggtacaactacacgcgggagacggtgggctcctccggcgtgcagacccacacggactcgggcttcctcaccgtgctccatgaggacgagtgtgtcggcggcctcgaggtcctggacccgggcaccggcgagttcgtgcccgtggaccccgtcgcgggctcctttctcgtaaacatcggcgacgtcggcacggcgtggagcaacgggaggctgcacaacgtgaagcaccgggtgcggtgcgtcgcacccgtgccgcgcatctccatcgccatgttcctgctcgcacccaaggacgacagcgtgagcgcaccggcggcgttcgtggacgcggaccacccgcgcaggtacaaggtgttcaactacaacgactatcggaggctcagactgtccaccggcgagcacgcaggcgaggcgctcgcacggatggcggcgtga

SEQ ID NO: 21 - protein, 299 aa, Zea mays
MAEIPVIDLRVAGSAAEESARLRAACERLGCFRVTGHGVPSVLLAEMKAAVRALFDLPDDAKRRNADVITGSGYVAPSPTNPLYEAFGLLDAAVPTDVDAFCALLDAPPNIRETVKAYAEKMHDVIVGVARELASSLGLVEEHSFQDWPCQFRINRYNYTRETVGSSGVQTHTDSGFLTVLHEDECVGGLEVLDPGTGEFVPVDPVAGSFLVNIGDVGTAWSNGRLHNVKHRVRCVAPVPRISIAMFLLAPKDDSVSAPAAFVDADHPRRYKVFNYNDYRRLRLSTGEHAGEALARMAA

SEQ ID NO: 22 - DNA, 1496 bp, Zea mays
gtcggtctcttgtctcaccaaaccggcgacatggtacatggaggccagcccgtcgcttggcgccacaagtctcggtgccgtccgtccgacaagcggcgccagcgcacgctggctgctcgtgcacgcctctaaatacggccccggacccgccaccaagcgaaggccaatcccgtccgccgccccccaccaaccacgaaccacgcaagcgaacccggccggcgcggggcagcggcgatggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcctcgacgcgccgcccaaagtcagggagaccgtcaagacctacgcggagaagatgcacgacgtgatcgtcggcgtcgccggcgagctggccaccagcctggggctgggcctggaggagcactcgttccaggactggccgtgccagttccgcatcaacaggtacaactacacgcaggagacggtgggctcctccggcgtgcagacccacacggactcgggcttcctcaccgtgctccaggaggacgagtgcgtcggcggcctcgaggtgctggaccccgccgccggtgagttcgtgcccgtggaccccgtcgccggctccttcctcgtcaacatcggcgacgtcggcacggcgtggagcaacgggaggctccacaacgtgaagcaccgggtgcggtgcgtcgcgcccgtgccgcgcatctccatcgccatgttcctgctggcgcccaaggacgaccgcgtgagcgccccggaggcgttggtcgacgcgggccacccgcgtcggtacaagccgttcaactacgacgactaccggaggctccggctgtccaccggcgagcgcgcaggcgaggcgctcgcgcggatggcggcgtgatgtcgtcacgcacgtgcaagccgttaattataggctcgcgcatgcatacgcctacacgagaggttgtctcgttaagccgttctattaaaatgtgtgggggagaaagatgactaccgtggtgccatgtggattgctatcgggtctgatcaataaaatcttgcaacacttgcacgtgcgattccatatcctagcacgggtgggcgccacgctagtaggtagagaccggagcggccaaaaaatggctacagcaccagtaggtgaactctcaagcaacactggctatcccacttctgacgttgtctctctcatcactatgtatgaccagcgaatgaagtgtttaaaaatctgacgccgtgaaa

SEQ ID NO: 23 - DNA, 903 bp, Zea mays
atggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcctcgacgcgccgcccaaagtcagggagaccgtcaagacctacgcggagaagatgcacgacgtgatcgtcggcgtcgccggcgagctggccaccagcctggggctgggcctggaggagcactcgttccaggactggccgtgccagttccgcatcaacaggtacaactacacgcaggagacggtgggctcctccggcgtgcagacccacacggactcgggcttcctcaccgtgctccaggaggacgagtgcgtcggcggcctcgaggtgctggaccccgccgccggtgagttcgtgcccgtggaccccgtcgccggctccttcctcgtcaacatcggcgacgtcggcacggcgtggagcaacgggaggctccacaacgtgaagcaccgggtgcggtgcgtcgcgcccgtgccgcgcatctccatcgccatgttcctgctggcgcccaaggacgaccgcgtgagcgccccggaggcgttggtcgacgcgggccacccgcgtcggtacaagccgttcaactacgacgactaccggaggctccggctgtccaccggcgagcgcgcaggcgaggcgctcgcgcggatggcggcgtga

SEQ ID NO: 24 - protein, 300 aa, Zea mays
MAEIPVIDLRLAGSSPDESARLRDACERLGCFRVTGHGAPAGLLADMKAAVRALFDLPDDAKRRNADVIPGSGYVAPCPANPLYEAFGLLDAAAPADVDAFCARLDAPPKVRETVKTYAEKMHDVIVGVAGELATSLGLGLEEHSFQDWPCQFRINRYNYTQETVGSSGVQTHTDSGFLTVLQEDECVGGLEVLDPAAGEFVPVDPVAGSFLVNIGDVGTAWSNGRLHNVKHRVRCVAPVPRISIAMFLLAPKDDRVSAPEALVDAGHPRRYKPFNYDDYRRLRLSTGERAGEALARMAA

SEQ ID NO: 25 - DNA, 1614 bp, Zea mays
accacacgaattgcacatctccacagctcacgattccaacactagctacatatatatgtagctttctaggctactatatacactcaccaccaagtgtgaagtgtgtatatatagtgacagctactgcaatatatacatacgcgtcacctatatattagccaagctagctatatgagcttggttgcggcgccaatggcgatcgtcgacgtggccaacgcccagctgcagcaagcagcagcagcagctgccaagaaagacgaggacggccatgagcagcaggagtcgtcctacgactacggcgcgctgatgaaaggcgtgaggcacctgtcggacagcggcattaccaggctgcccgacaggtacgtcctgcccgcgtccgaccgccccggcgtccttgccgtctcgtcgtccgtggcgggcagcggcagggtcaagctccctgtcgtcaacctcgccggcctccgcgacccctgccagcgcgccgccgtgctggccacgctcgacgccgcgtgccgggagtacggcttctttcaggtggtaaaccacgggttcgggagcgacgtgagcggcgggatgctggacgtggcgcagcgcttcttcgagctgccgctggccgagcgagcgcggcacatgtcggcggacgtgcgggcgccggtgcgctacggcaccagcttcaaccaggccaaggacgacgtgctctgctggcgcgacttcctcaagctcgtctgccagccgctgcaggcggtgctcccgtactggccccagcagccggcggacctcagggacgtggccaccaggtacgccacggcgagccaccggctgttcatggaggtcatggaggcggcgctggaggccctgggcatccccacggccggcggcgtgctcggggagctggcagcgtcgtcgtcgcacatgatgacggtgaactgctacccggcgtgcccgcagcctgagctcacgctggggatgccctcgcactcggactacggcctcttcacgttcgtcctgcaggaccacgtcgagggcctccaggtcatgcacgacggccgctggctcaccatcgaccccatcccgggatcgttcgtcgtcaacgtcggcgaccacctagagatctacagcaacgggcggtacaagagcgcgctgcaccgggtgcacgtgaactccacgcggccgcgcatctcggtggcgtcgttccacagcctgccggcggagcgagtgatcgggccggcgccggagctggtggacgacgaggccggcaacccgcggcggtacatggacaccgacttcgctaccttcctcgcctacctcgcatccgcggacggcaagaacaagaccttcctccagtcaaggaagctgcctgctgctgctcctccatgcctctagctaactagatagctgcttattaatctgacagaataaaattaatcagttcagcgcacaattccacaagcgaaaacaaacctggatttgttttaattagctctgcccttcattattacattcaagctagctcttggtcaacgcatgcacacaagcttgagcattgactggtcccttttcaatcggttgcattgtactccctccgtaccaaaattggttgtcgctatagtattt

SEQ ID NO: 26 - DNA, 1212 bp, Zea mays
atgagcttggttgcggcgccaatggcgatcgtcgacgtggccaacgcccagctgcagcaagcagcagcagcagctgccaagaaagacgaggacggccatgagcagcaggagtcgtcctacgactacggcgcgctgatgaaaggcgtgaggcacctgtcggacagcggcattaccaggctgcccgacaggtacgtcctgcccgcgtccgaccgccccggcgtccttgccgtctcgtcgtccgtggcgggcagcggcagggtcaagctccctgtcgtcaacctcgccggcctccgcgacccctgccagcgcgccgccgtgctggccacgctcgacgccgcgtgccgggagtacggcttctttcaggtggtaaaccacgggttcgggagcgacgtgagcggcgggatgctggacgtggcgcagcgcttcttcgagctgccgctggccgagcgagcgcggcacatgtcggcggacgtgcgggcgccggtgcgctacggcaccagcttcaaccaggccaaggacgacgtgctctgctggcgcgacttcctcaagctcgtctgccagccgctgcaggcggtgctcccgtactggccccagcagccggcggacctcagggacgtggccaccaggtacgccacggcgagccaccggctgttcatggaggtcatggaggcggcgctggaggccctgggcatccccacggccggcggcgtgctcggggagctggcagcgtcgtcgtcgcacatgatgacggtgaactgctacccggcgtgcccgcagcctgagctcacgctggggatgccctcgcactcggactacggcctcttcacgttcgtcctgcaggaccacgtcgagggcctccaggtcatgcacgacggccgctggctcaccatcgaccccatcccgggatcgttcgtcgtcaacgtcggcgaccacctagagatctacagcaacgggcggtacaagagcgcgctgcaccgggtgcacgtgaactccacgcggccgcgcatctcggtggcgtcgttccacagcctgccggcggagcgagtgatcgggccggcgccggagctggtggacgacgaggccggcaacccgcggcggtacatggacaccgacttcgctaccttcctcgcctacctcgcatccgcggacggcaagaacaagaccttcctccagtcaaggaagctgcctgctgctgctcctccatgcctctag

SEQ ID NO: 27 - protein, 403 aa, Zea mays
MSLVAAPMAIVDVANAQLQQAAAAAAKKDEDGHEQQESSYDYGALMKGVRHLSDSGITRLPDRYVLPASDRPGVLAVSSSVAGSGRVKLPVVNLAGLRDPCQRAAVLATLDAACREYGFFQVVNHGFGSDVSGGMLDVAQRFFELPLAERARHMSADVRAPVRYGTSFNQAKDDVLCWRDFLKLVCQPLQAVLPYWPQQPADLRDVATRYATASHRLFMEVMEAALEALGIPTAGGVLGELAASSSHMMTVNCYPACPQPELTLGMPSHSDYGLFTFVLQDHVEGLQVMHDGRWLTIDPIPGSFVVNVGDHLEIYSNGRYKSALHRVHVNSTRPRISVASFHSLPAERVIGPAPELVDDEAGNPRRYMDTDFATFLAYLASADGKNKTFLQSRKLPAAAPPCL

SEQ ID NO: 28 - DNA, 1863 bp, Zea mays
tgccaccataccactagtgcaaggtcctagatttacacttggtgctacaccttgcttcgcccccttccttccttccttccttccttccctccttccttggtctctaggcagctagcagtgtggtgctgctgccggccgcctattggccgcctgggactgggatccattaattactgcgcgcgcgcggctaaccaaccaatcccagcgtgcgtaatctattgcccacatgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctgtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtagccgagaccgatcgccggagactgatgctgatgatgatgcatatatacatgagagaaatcgtcgagtagactagccgattgcaaaagcaaccccagctgccgaaacctggcatatcgatcccattctctgctgcgcacatgtatgcatgcatgcgcttcgtccgttcgactcgtgtgtgcttgcttgcttgcgcgtgcagcagaactaattccgttccgcagctagctgctctgctctgctctgctggaatgtaattaagtagtagtatatggtagtagagaaaagattagctaggcgatcgatatagatgacgggccggggaagaagacgaattaattaagatcgatcgacgacgacgagctgtgcgtggctggctgtgttcttctctagcctagttacagaggccggctgctgctgcttccaatcgggctgcttgtcgctactgacgatcgttagtggatccattaactaatctggaattctggatt

SEQ ID NO: 29 - DNA, 1149 bp, Zea mays
atgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctgtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtag

SEQ ID NO: 30 - protein, 382 aa, Zea mays
MPTPSHLNKNPRYLDFRAARRVPESHAWPGLHDHPVVDGGAPGPDAVPVVDLGAADPAPAPAAAVARAAEQWGAFLLTGHGVPADLLARVEDRIATMFALPADDKMRAVRGPGDACGYGSPPISSFFSKCMWSEGYTFSPASLRADLRKLWPKAGDDYTSFCDVMEEFHKHMRALADKLLELFLMALGLTDEQASAVEAERRIAETMTATMHLNWYPRCPDPRRALGLIAHTDSGFFTFVMQSLVPGLQLFRHAPDRWVAVPAVPGAFVVNVGDLFHILTNGRFHSVYHRAVVNRDLDRISLGYFLGPPPHAKVAPLREAVPPGRAPAYRAVTWPEYMGVRKKAFTTGASALKMVALAAAADLDDDGDAAVVHQQQQLVVSS

SEQ ID NO: 31 - DNA, 1439 bp, Zea mays
gacctccattttgattatctctatcctgtacgtgccgagagtccttcaaagccgacgacgagacgacgatgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctgcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaagccctaaggaactactagctgaatccataaactaataaagaattcgtgaataagggcgttggaagactggacacaacacaagagagttgctatatatcgtatttctgaaatttaaggcaaatatcttagttaaaaaactggtatatttaaatagacaatatatatctaaaataaagatagttcaccatttttacggtcgaacaatgataaagttatatattgtctgaatagtaacaaattaaagatttccaggag

SEQ ID NO: 32 - DNA, 1116 bp, Zea mays
atgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctgcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaa

SEQ ID NO: 33 - protein, 371 aa, Zea mays
MQSSSSSASTPAAASGLVFDLGSAAGVPETHAWPGVNEYPSVESAGRDVVPVVDMGVACPDATRALARAADEWGVFLLVGHGVPREVAARAEEQVARLFVLPAPDKARAGRRPGEPTATGYGRPPLALRFSKLMWSEGYTFRAATVREEFRRVWPDGGDDYLRFCDVMEEYDREMRALGGRLLDLFFMALGLTDVQFATGETERRIRETWTATMHPILCPEPERAIGLTAHTDSGFITLIMQSPVPGLQLLRRGPDRWVTVPAPPGALIVMLGDLFQVLTNGRFRSPIHRAVVSRERERISVPYFLCPPEDMTVAPLASALLPGRKAVFRAVTWPEYMEVKHKVFGTDAPALEMLQLQVDEEEQGERAATT

SEQ ID NO: 34 - DNA, 4095 bp, Zea mays
taaatttgtgatccttgtgaagttgttatatcatgaattgtgaacttgttgcatttgtgatcttttgtcaactttgttgtattgtgaagtttgatatgtttaccgatcgtattttagatttcgatcgttaccggtgtattttccgcaccaaacttttgtttccgatgttttcgaaataccgatatcgtttccgtttctatagttacccttttcaattttatttccgattaaaaatatgaaaacggtaatggttttagtgtttatcgaccgttttcatctctaatcatccctgccggtgaagtttaatttttcccttggctaaagagatgcaagctgctgtaaaatacgttaaaacaggcaaggcagccccagcagccagcatcgcgtgcccgtctatgtacatcagtggatacgtagcatctctagtgagtaatataacgattgcatttggctggaggacgtatgttatataagtatgtcatttaccagttgcattagtatcttccctaactcctataataactctcttcgtggaatggacgtagacgtatgctatataagtattaaaaaatagttttttaagctggtgtcctcaattttgctattgttctcgtttttatctttagttgtgtcacaaatttaatccgtacaacaaatcaaaaataccatacccttcttatattaattttctaacataacatttgtttagatattttcagtcgtgaaaatacaattctaattctaacgtcgtagtatcaaatcaaaccatccagaatttgaccaagcttaattataaaaaatataaaatttatgatactgaatagatagcattagatttgttatataatatatttttataaaataccatttttatggtataaatattggtactcctttactttaaactatagatagttttgactaaggatgcaactagaattgcatcctcttttcactgcaccttcattagttttaatatttatttagatgggcccttgcaaactgtagatatcatctcttgcaacattctttctatagcaccacgaaaatgtattgcggctttgaaattataattgaattagttgtatcatttctttcaccgatgcgttaaattcaaaattaagtgttatatttcttcataatttgttaaatatatagaccctataatccaccattatttactataatagcatacattaacattggttttagcctacactacgacactcgaggcattgaattttcctctatcaaagaattatatgtgtagtagtattgttcttgacaaaaagggggattaaaattaaactaccaatattgatacttatcttatcacatccatgaatacaatcaacactcttacaaaagataagatacaagattaaaaagtaccatgataatacattaagattattagcaatgcattaaattaaataaatgtgcaagtgaatcatgattttagttttatctattttacttttaaaatatgatattctctgactacttctaagcataaatgtgattctaagtcatgaccgatcgtgcttattcagaaaaatgaaggagacacagatttctataaaaaaaggttgtcatgggactattgggtcaaccatcttattcatttgggaaaataagtttagaacacatcaacccattttagatgttgagtttggccctaatggtccattgaccttacttttgtgggttgacatagaccatctatcccaagttattgttgtgtcacattccctgatatcatgaatctatattttagctttccgttttcatatttttagtcgttacatattttttatccgcgtactagattaaaactctagttgttgcaatacattttgttcatttttttctatttcttctttactaacaacatattctagttcctagctacattcttaagtaccatagtgctataaacattttttatcctacattattccacttaagaaattgaattttctgcataaaaaaattatatgtccagtagtgttgtcttataaaagcataaagtgattaaaattaaaaccattattgatatcttatttttcaaaaaaaaatataagcttatagaaagtgaattaatttcatggtaaattaatatagtttaaattgaattattagtgttattactatgtttattatcaatgaaacatttttcatggttgatataacttagtgttacttattttagtattttttatataattctagttaacttttagtttttgatttaaaaaaacgagaattgtgtccttttgtggagtgagtataaagaaagtaatatctgttcatcataatttggttttttaaggtacgtgaaacttgctttatatttggactcaagctatgtctaaatacatagtaaaaaagcaatatttctagaaaagacaaaacatcttataatttagaatcaaggaaatatatagattttatgtgcagtgagaagccatttacaatggaacgttcaacgttgggccaatagatattttgcgatatgatgatgggcatatttttgcatggttgtccctccactagctatagtttgatgatacgatacgctgcacacaccattgggttgtaccatgttagtgtagcaacagtagaaacccaattgtggccgtgaaccatgataatactaggtagagtgctagctagaggtttcaggctattgatgcgtgaattaaactttctgttgtgttgcgaggaaacgagtattgtgaaatatttgaaacggttttttttgtgaaagatttgaaacggtatttttgttgtgaaataaagatcaaggctaaataaattcaaactaataaaacatattaattgacggcctgaagcccccgcccccatggccccatgccatagcatcaggtcccacatgacatgaggccgcgcctccctctatgttggctccctgccttcgccgttgtcgtcgctcccgaactccctctcctcccctgttacaaatacccccacccgcccggacagcttccctgcacactcgcagctcgcacatctcatggtgtcctaagaacggcaagagccagctctgcctagcagcagcgcacagccacatccatggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggtgagtaaagaagaagatggcgccgaatttacatttataagtaggaccagcagaagcccctgcccctgggggccttagcattgcattcgactgatgaatacgcatggcaggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttca

SEQ ID NO: 35 - DNA, 7404 bp, Zea mays
cctattttgtgtctaatactcttcttatattaattgtttggtcaaactttagataaatttgactaatgatgcaattaaaactgcatcacctttactaaggtactgctttatatgtttcgacaaaattttcaattattctctatgtgttttaatctttgcgctacacctccattgatttaaatactcatttattttaaaccataacttaaattatatcggatctttgcatcctttctatggcaccatacatgaatcgatattttggctgcaaatttttaatcatgttagttttagcattttttcatatccatgtgttaagtttgaatcatgtgttgtttttatataatttattgaaaatatagatcctaaacttcactaatacttacaacaatagcatcatcatgtgttttaatccacgccacaacactcaaggcattgaattttcttctaccaaagagttgtatgtgtgtattgttctttaaaaaatagagtgattataattaaactaccagtattcatatgtaaaatgtatagacatctaaaataaaatttgcaaaaaacattgttgcagactttcaatataattaagaatgggttttagggtcatgatatatggtttgttaaagaaacttgtttttttttgcaattgataaactataaaatacattttcactattgtgtgcatatgtacttggtatacatagtggcatatatcatttttgtttactttgaggtttgaattatctatgttaaaattggataacatagatacattggtgtgcgtcctttggcccatttacttgactgaggagcaatactataaagtaaaacatatttggatattttatcttaaactcctagcataatattgatttaattatgaacaaatatatgtttaggtgatagtttcatgggtggtaaactatataagaaggcttaccatgatctttgcaaactctaggctatgaaagagttccatgatttgtcttagaagcatagacaaaacagtgataatgatctaaatcacacttatggcactgatgaccatatatgcaaagctaaatgcatgttaagttgtattatatcatatgtttacaatgactatcgcatataacgaggaatacattgtctatatagatagctattactgtagtagtgccaaatgttggacaacatgaatcataatcttcaaacctagagaaattgtagtcagtcgtacacatatcgtctagtaagttgtctatactttttatttattgtatcaaattttattgttatcttgcttgcttgtttgtttgtaccatagacacaatatggtcaaaaagtggtcaatcgattcgaagaagattgcaattgacgagtgctaacagttgatccttttgttgtgcacgctagcggagtagcatgaaaagagtaaaatatgaaattagcgttctaaactgtttgtgctataggtacttcgtatttaatggagtgactaactataggaaggtgagagctcagaagtcagcaccctcacacagagttctagagttagtggtcatcgaaccacgacaaactacatgatgagcagaagaggcaacatcaagactatgatcaatagtttcgggtcaatgaatgacatcgtgatgagtatttatctaactatatagaacaacaacacatgatgttttaagtaagttcaactgatcttctattgctatctttaagtatttaacgtagcgaataatgttttatctatttcattcataaataatgttgtgacaaaaggggataaccatcacttttaccatgttctagataccacaaccatctccaccatcataatgggttcttcattggtgcttggacctcaaataatcatatctatagccaacttagctcaattctaataaaattaggcaacttggcttcattgtagcaaaaatagccaacttagctcaattttatctaaacttagctaatctagcacaacttagatcaatattaggaaaaactaatcaatctaatctagctcaactatagcgaaagatagatattgtagcataacttagtagatctatctcaaattttagcaaaaactaatcaatttagataaactctataaaattttaatcattatgacttatttccaactaattgtaacttgcatgatttttatgttccttctttataattagcaacacctaaagacacgaatgatgaggggtctaacgcattcattaaccagttgttaaataatactctaggtagatgataagaactctaattattctatgaatctaagctaaaagatgtttaatatttaagtattggtgtttattatgttatttagaacgattcatgttacttaaagatttgttatgatttttaaatatgattatgataatttatgtggtgtggattaacttgtgaacatatgtgatgtagatgaatatgtatgttgtggatggaaccatatgaatatatatacacactcatatactattcgttggtgtaggtaaagcttcatccatcggtaattactaaatggtcttcagtcattaccactaggtgaagcttcacacgaccgataattattgaagaacgctcattaatttccggtaatggcttattggccttcactagtcggtgaaaattagctatttttataccaataaaaattagctaatatatgtaaaccaggtctaatttttatgggcctcttaccgaccaaaattgattagattattgttacaatagttttagtcaaaagctagctatgctataaaaattttgaattaaagtgagtttcgtaataaaaattgcatacttttaaaataaaataattaaaaaacagtttttagaaatacaatcaaacaccttatgctataaaaaaattgtaatgtacctacaaatatataatactttactttaaaataggcctgtgccttctcggctctatatgggctgcctccaacgaagcgccatggccatgggctccactgtgtcgggtcccacatgaggccgcgcctccctccaaatgttccctccctgccttcgtctttgtcgttgctcgcaaactccctgtcctcccctgttacaaatacccccacccgcccggacagcttccctgcatacttgcagctcgcacatctcatggtgtcgcaggaacgacaagagccagctgtgcctagcagcagcagcagcagcgccaagcgcgcagccacgtccatggacgccagcccggccccgccgctcctcctccgcgcccccactcccagccccagcattgacctccccgctggcaaggacaaggccgacgcggcggccagcaaggccggcgcggccgtgttcgacctgcgccgggagcccaagatccccgcgccattcctgtggccgcaggaagaggcgcggccgtcctcggccgcggagctggaggtgccgatggtggacgtgggcgtgctgcgcaatggcgaccgcgcggggctgcggcgcgccgcggcgcaggtggccgcggcgtgcgcgacgcacgggttcttccaggtgtgcgggcacggcgtggacgcggcgctggggcgcgccgcgctggacggcgccagcgacttcttccggctgccgctcgccgagaagcagcgcgcccggcgcgtccccggcaccgtgtccgggtacacgagcgcgcacgccgaccggttcgcggccaagctcccctggaaggagaccctgtcgttcggctaccacgacggcgccgcgtcgcctgtcgtcgtggactacttcgtcggcaccctcggccaggatttcgagccaatggggtaagtaaggtagtaagaaggagcgccggtttacatttaccgcacgtcggcgtgcggtcgagtcgggactcgggagacgtatgaacccccgtcccgtcccatgcatgtgtggcaggtgggtgtaccagaggtactgcgaggagatgaaggagctgtcgctgacgatcatggagctgctggagctgagcctgggcgtggagctgcgcggctactaccgggagttcttcgaggacagccggtccatcatgcggtgcaactactacccgccgtgcccggagccggagcgcacgctgggcacgggcccgcactgcgaccccacggcgctcaccatcctcctgcaggacgacgtgggcgggctggaggtgctggtggacggtgagtggcgccccgtccggcccgtcccgggcgccatggtcatcaacatcggcgacaccttcatggtaacgaaacgaaagcgctcgctcctctgttttccttggccgctcttgtcctgtgtgtatattcagttgagctctctctgtgctgttatttcccgaatcctagtggacctaaacgggcaggttattacagcacgcacacgtaggcatgtcatgtagctagtacatacatagcgatgccgatgcaaatgcaatagagacatgcgttcgagttggttcctatctcggcgggctacggcaggtacacgcggccgcggcgcgctctctctagtctatccgcggccgcgcccaggccgatcgaggcttccgggggagagttgcgacaagagaacggaccgagggggtcggctagcggtagcaagttccctgttggtttgtggcgttggagcgttgcggagaggcttgcgcggcggcggggacgtcgacggggacgtggcggggagacgatacgatgggtgccgggcaggtttccgaattccaaacgtttttgtggcgtgcgtccatggggcgcccccaaacttcggacgtttccggcgctccaacaaatcttctcgcttcacacgtcaccgtcgtcccggattcatttgcctcgtcgctccaccattcgctgctctcctctccacgtactcttaccctgacctttgggaaagaactgaacattcgagatgcacaacagttcaaatataacatatgcagcacaagatcgttcgactgctatccgacaagccaacaacgtgcccagtagaactgaatgtacctgtgatttccagcactaacttacagcaacgttgtgaaaaaacaaaaacgaaaacaaacggcagaaaaaacagatgtattgttctacagttacaccaaatattttctggtcctttcagcaccaacaagagccatacgcatatctagaagacaaaattcctctaatttcacccctacgtggtagcagttcctcctcaacacagttcacgtgctagcgtcgagttctttgggccgccacatcgacttctcgacgcagagcaggccctcgctgcccttggtgtaggtcatccgcacctcccactgcacggacttggccatgctctccagctcatttatcgtgtccgcggtgtccctcacgatcagcttgccctgtggcctcagtacacggtcgacctcggcgaaaactgcagccagtttgcatctgtaaacaggcaacacagatttttagtatctaaaacactgcaggcaaacgccacaggttttagtcgcaagaagcaataaaagcatgcaaacaatgctacgtgtacgtatcaaaggaacatgtcaaaactcgttgcatgaacgatcattgatgtttccttgctgaactagtcacatcagtctgcttcaacttctgggtttcactagtagatataccagaagggtagaataatgtgaagagcaagaaatacagacctctttctgagctttgagaacagatggtccgcgtgcagaaggtcatacgttcttgggtaagtgctgaaagactcgcaccagtcatggtacatgccaaacaaaccgcgctcgtagatgatgggcagcgtgtctggtgaatcgatcggcacgatattcatgacccagaccttttggtccctcagagctgcagcaaaactgccatgcaacaatgtaaagcattagtcaagaagaaggtgtacagtgcatttctccttgtcaacagtcttcagtaacaaaaaaaaagtgttatgcttgactgaatctttcaaagaaatatgcttgatgacttatggtggacaagttgcctgttatagtgttatgttttaattaactatgtgccagcttgggtaactagtagttatgtagtgtgatctgaattaccaaaatataaataaataaataaacatgcccaagaaactacgaaaaccatttacttaccctccatagacagctctcatgtccatgacatttctcactttggaccagtcaattcccatgccattcacatacgatttacttacaacccgtttccagtgggcattatctgcctcaaaatcttcatttgcaggctttccatagacaccaaccttggaaccatcaatccagaaaggggtcttctcaagcctttgcggccataactctggccattttgatcctcggacttttgagccaccaggcagtttgtgcatgcatgcttccaacggtacattcctgcaaatcaaaaggctgtgtaagcaaagcagagaagcacttttctccattgaaaatatactcttctcaaagaaccgaaaccataccaagcagcatctgcatcatcagattccttgcacaatggcgggctgttttcagatcttttctcatagcaaatattgtccattggtttctgatatatgaccataccaacttggtttaacttatccttagtcttgttgaccatcttccagcacatggactttgtcaaagtagacatggctgaaaagggtatgtggccacatgttatgttagaaataaaattcaattttgaacagttggtccatagcatgtattttgaacaaatgcaatccttctccatccatgaaagaagttgacccttcatacttaggattattcagtactttcactcatgtctgctgaatttgttctcttggtagttgctatacaagaaagggggaagtacagagtagctaaacttatacaagctatagtctgatatttgtatgaaacataaattttggtatggatgtcttattaaaatgggaggttgtataatatttttctagcctacctcaacttgcttgagactaaaaggctttgttgttgttgttgaggctgtatggtgctttgactttacaaatcaagttatcagctaccctacttatggatatacacctctcataaaatgatggtaagaagtttcgatatgtcacattaacataagaacttcattcagttagggtacaacgaagttaagtagttacggaaataccattccaaatctcaacatcctctgggagcttttggtaaacaggagtggcagaccagacaaagtaaccaccagggcgtaacaagcggttcaattccagcaaaagcatgccacctaaaagtagcgagccagcaataagattcagttctatagcaaatcaataaatgaaaggaggacatgtcaatatgtaaccagcaggacaaaccttcgatgtgccaaggga

SEQ ID NO: 36 - DNA, 1788 bp, Zea mays
aatcccagcgtgcgtaatctattgcccacatgccgacgccgtcgcacctcaacaagaacccgcgctacctggacttccgggcggcgcggcgggtgccggagtcgcacgcctggccgggcctgcacgaccaccccgtcgtggacggcggcgcgccgggccccgacgccgtgccggtggtggacctgggcgccgcggacccggcgccggcgccggcggcggcggtggcccgcgccgccgagcaatggggcgcgttcctgctcacgggccacggcgtccccgcggacctgctggcgcgcgtggaggaccggatcgccaccatgttcgcgctgccggccgacgacaagatgcgcgccgtgcgcgggcccggcgacgcctgcggctacggctccccgcccatctcctccttcttctccaagtgcatgtggtccgagggctacaccttctcgccggcctccctccgcgccgacctccgcaagctctggcccaaggccggcgacgactacaccagcttctggtacgttgcgttgcgtgcttgtgtgcgcgcacacctgccgaccgcggccacaccgtacgcaacccacgcgtacgtacgtgcgctagctacctgcttcgctcgcttcgctcctctcgcctcgccatgcatatgcacgtacggccgtacaggtacagcagcaggtcacacgcacgaacgcacgcacgcaccagcaccgatatgatacatcatcgacgtgtcgtccccccgtctaaggccatgcatgcatgcaagcacgcctagctagcccttttggcttgctagctgacgaggggagctaggacgagcatacttactgtgcgcgtcatgctcaattgctcacactatactactacttgttactacagtgatgtgatggaggagttccacaagcacatgcgcgccctcgcggacaagctgctggagctgttcctcatggcgctggggctcaccgacgagcaggccagcgccgtcgaggccgagcggaggatcgccgagacgatgaccgccaccatgcatctcaactggtgggtatatattattgtctgtcatgttgtcgtcgtcgtacgcgttgcggttgggtgtacatgtatataacacaaacaacaaaaaactaacgccgtgccgacgacgacgacgatcatcaggtacccgaggtgcccggacccgcggcgcgcgctggggctgatcgcgcacaccgactcgggcttcttcaccttcgtgatgcagagcctcgtgcccgggctgcagctcttccgccacgccccggaccggtgggtggcggtgccggccgtgccgggcgccttcgtcgtcaacgtgggcgacctcttccacatcctcaccaacggccggttccacagcgtgtaccaccgcgccgtcgtgaaccgggacctcgacaggatctcgctcggctacttcctcggcccgccgccgcacgccaaggtggcgccgctgcgcgaggccgtgccgcccggccgggcccccgcgtaccgcgccgtcacgtggcccgagtacatgggcgtccgcaagaaggccttcaccaccggcgcctccgcgctcaagatggtcgccctcgccgccgccgccgacctcgacgacgacggcgacgccgccgtcgtccatcagcagcagcagctagtcgtctcgtcgtagccgagaccgatcgccggagactgatgctgatgatgatgcatatatacatgagagaaatcgtcgagtagactagccgattgcaaaagcaaccccagctgccgaaacctggcatatcgatcccattc

SEQ ID NO: 37 - DNA, 1698 bp, Zea mays
cgtgccgagagtccttcaaagccgacgacgagacgacgatgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcccgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctggtacgtacgagcgccatgtcacgtgcttgtgctttcatgcctcgtaccgtcgtcgtgctgtacgtgttatgtttatcggccggtacgtcacgcgtgctacactggttaacgacgtgagcgtgcccacgttgactgcatgcatgtgcatgcgcgcgcccagcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtacgtacgtcaaaaacgaatatctgaccaatgcaaacgtttttctgcaatgccagtcatccactcatcctgtacgtacctctggactctgcttgtccatctactgatgacacgtatggtaggtaccccaggtgtccggaaccggagcgcgccatcgggctgacggcgcacacggactcgggcttcatcacgctcatcatgcagagccccgtgcccgggctgcagctgctccgccgcgggccggaccggtgggtgacggtgccggcgccgccgggcgcgctcatcgtcatgctcggcgacctgttccaggtgctcacgaacggccgcttccggagccctatccaccgcgccgtcgtaagccgagagcgcgagcggatctccgtgccctacttcctctgcccgccggaggacatgacggtggcgccgctcgcgtccgctctgctgccggggaggaaggccgtgttccgggccgtgacgtggccagagtacatggaggtcaagcacaaggtgttcggcacggatgcgccggccctggagatgctgcagctgcaggtggatgaggaagaacaaggtgaaagggccgccaccacctaagccctaaggaactactagctgaatccataaactaataaagaattcgtgaataagggcgttggaagactggacacaacacaagagagttgctatatatcgtatttctgaaatttaaggcaaatatcttagttaaaaaactggtatatttaaatagacaatatatatctaaaataaagatagttcaccatttttacggtcgaacaatgataaagttatatattgtctgaatagtaacaaattaaagatttccagg

SEQ ID NO: 38 - DNA, 4095 bp, Zea mays
cggtctaagtgaccgtttgagagaggaaaagggttgaaagagacccggtctttgtgaccacctcaacggggagtaggtttataagaaccgaacctcggtaaaacgaatcaccgtgtcatccgccttatttgcttgtgatttgttttcgccctctctttcggactcgtttatatttctaacgctaaccccgacttgtagttgtgcttaaagtttgtaaatttcagattcgccctattcaccccctctaggcgactttcatataaatattgggagaaatatgaaaaacaaatgaaggtcgaacgagtcagagacaccataaaaaagaggtcgtcttaactagggtgctaaacctcaacattgtagtagatcttagtactgagtttgacatctttgacaccaacaagatggtgatacgttactttctacgttaacttgggtaggtatatcgactatagtggcctataacactaggctatgtaatatgatattgtgttgagtctttataaacatgattttttttaaaaaaaagagctaaaataaaaaatagaaatcgacggtacgatgcaagttcttctcaagacaaccaaacgcacccttgcccctttattgaaattgaagtatgtgctttatcaaatgtttaaatactaattataagtattaaatataatttaattataatactaattatatagataaagactaaataacaagacaaatttattaaatataattaattcattattaacaaatacttaatgtagcacgatcgaatcatggactaattagtcttgatagactcgtcttaccatttaatcataattagttttgtatactgtttataatatttctaactagctagtattaaacttttgatgtaacctaactaaagtttagtcacgccaatacataaggactcggatcgttcgatcacccatgacatcacgtatactaagagcatctccaaaagctctccagaagtctcccctaaatctatttttttgggaaaaacacaaaaacatgtctccaacagttcccttaaagcgcccccaactttttcatagcccttaaaactccctcatttgtagctacaaatgaggggttttttgggctccccagaaacaaactgttgatttaagggatctgttggagaaaggattaaaatttaccctcacttattatttagatgtcccttaaaactgattttgaggagtcgttttatgtagagctcttggagatgctctaacacaccgagcacaaccgcatcatcaatcaaaacaacccaaagtttgttcggtacaagtcatcagcctgtgtacacacatcagcctcggccccgggagaagcgctagcaaacaaggttcacctaaaaatccatccagattcattgaatccaaccagcacaaacgtcccatttattaatcacctcatcacaggtccccccagcctcactctcgcgccggctcaaggtacattgcgtgtcctagccaagacacgcagctcatctcagcctcacacgcacagcaagagcgaggcgtgattcgccatgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgagcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggcagccgtggccgacggcgagcttgtgttcgataacaagtggccccaggatctaccgggcttcaggtgacgaaattaactatatatccctttcgatcatagttgcgttaataaattaagggaatcgtgagcgtacgtacgtaagtttccgcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgtgcccacctgatgaactgagctgaacgtaggttgcatgcactgcatgtgtataggcttctcagatcgcttcgtgtggcgtaaggtgtggagcaacgacaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatgtgaatatgtaatatgatgagcactcctactttggtatgtttgggaataacagacttgtgttggtctggttcattatttgtaagaaaatcaaaaagagttagtagggcaggaggctaaccacagtcatgctgcaccacatccctggtggaaagctggccgggttacgctacgctcgtgcagccagattactgcagggccgggatatgcttccggtggaaggaaggggacggtggctgaggaccatggggctggagcctgggagagaggtcgagctagaagaaagggggagagagaagacgcacaacgaagatgggtcagccagggatttcgacccaagggggagctagtggattttgggagaaaacagaaaagagaaaagagaaaagaagaaaaatttgttggtgtgaacacaaggttgatttgtcttttcttatttggattgatgatgagtcgtggactaaccgacccgtgagctattgtgtcgtataatcatgtctctcggtttctggtgtgcaggtttgaagcacagagacggtggtcgacgcaaaggtgaacgtcatgcaggttcgtgccgatggaccgggagcagtgaaagacgagcgttgggacttgaacaagggaccagagtcgccggatgactagccgcagtggctgacgcctggaacacgcatagacgtgaggacgtggtagagcaggtgaaaatcgcctagagggggggggggtgaatagacaaaacctaaaaattataaactttgaacacaaactttacctgaggttaccgttagaacgagtattaatgaaatcggagtgcggaaggcaagttcttcttgctacgagttgcttaatcaatattgataactttgggagtcaactcaaaatgatcacaagcaaaagaactagagagagaggagaggaagaatcaactcgcaaagtaatgatcaacacaaatgaacacaatgatttatttctcgaggtttggttccgaagaacctactccccgttcaggagtccacataggacatgtctctttcaaccctttctctctctcaaatggtcacatagactggttcagttgagagcacctagaggggggtgaataggtgatcttgtaaaatcaaacactaatagccacaaaacttagtttaaagtgttagtacggctaagtagctttgaagcgagttattgtgaacacaacaat

SEQ ID NO: 39 - DNA, 21 bp, Artificial Sequence
  suppression oligo
ctccatcatgcggtgcaacta

SEQ ID NO: 40 - RNA, 21 nt, Artificial Sequence
  suppression oligo
uaguugcaccgcaugauggag

SEQ ID NO: 41 - DNA, 19 bp, Artificial Sequence
  suppression oligo
ggtactgcgaggagatgaa

SEQ ID NO: 42 - RNA, 21 nt, Artificial Sequence
  suppression oligo
uucaucuccucgcaguaccua

SEQ ID NO: 43 - DNA, 19 bp, Artificial Sequence
  suppression oligo
caggcgccatggtcatcaa

SEQ ID NO: 44 - RNA, 21 nt, Artificial Sequence
  suppression oligo
uugaugaccauggcgccugga

SEQ ID NO: 45 - DNA, 19 bp, Artificial Sequence
  suppression oligo
tcatgcggtgcaactacta

SEQ ID NO: 46 - RNA, 21 nt, Artificial Sequence
  suppression oligo
uaguaguugcaccgcaugaua

SEQ ID NO: 47 - DNA, 19 bp, Artificial Sequence
  suppression oligo
tcgctcgccttcttcctca

SEQ ID NO: 48 - RNA, 21 nt, Artificial Sequence
  suppression oligo
ugaggaagaaggcgagcgaca

SEQ ID NO: 49 - DNA, 19 bp, Artificial Sequence
  suppression oligo
tccaacgggcggtacaaga

SEQ ID NO: 50 - RNA, 21 nt, Artificial Sequence
  suppression oligo
ucuuguaccgcccguuggacc

SEQ ID NO: 51 - DNA, 19 bp, Artificial Sequence
  suppression oligo
gcatcaacaggtacaacta

SEQ ID NO: 52 - RNA, 21 nt, Artificial Sequence
  suppression oligo
uaguuguaccuguugaugcga

SEQ ID NO: 53 - DNA, 19 bp, Artificial Sequence
  suppression oligo
tggacgatggatagttcaa

SEQ ID NO: 54 - RNA, 21 nt, Artificial Sequence
  suppression oligo
uugaacuauccaucguccauc

SEQ ID NO: 55 - DNA, 19 bp, Artificial Sequence
  suppression oligo
tggaccatggatacttcaa

SEQ ID NO: 56 - RNA, 21 nt, Artificial Sequence
  suppression oligo
uugaaguauccaugguccauc

SEQ ID NO: 57 - DNA, 19 bp, Artificial Sequence
  suppression oligo
gcaaggtcctagatttaca

SEQ ID NO: 58 - RNA, 21 nt, Artificial Sequence
  suppression oligo
uguaaaucuaggaccuugcaa

SEQ ID NO: 59 - DNA, 19 bp, Artificial Sequence
  suppression oligo
cagagtacatggaggtcaa

SEQ ID NO: 60 - RNA, 21 nt, Artificial Sequence
  suppression oligo
uugaccuccauguacucugga

SEQ ID NO: 61 - DNA, 19 bp, Artificial Sequence
  suppression oligo
ccatgccctacttcttcaa

SEQ ID NO: 62 - RNA, 21 nt, Artificial Sequence
  suppression oligo
uugaagaaguagggcauggaa

SEQ ID NO: 63 - DNA, 19 bp, Artificial Sequence
  suppression oligo
acatggcggtcaacttcta

SEQ ID NO: 64 - RNA, 21 nt, Artificial Sequence
  suppression oligo
uagaaguugaccgccauguga

SEQ ID NO: 65 - DNA, 726 bp, Rice tungro bacilliform virus
tcctacaaaagggagtagtaatatttaatgagcttgaaggaggatatcaactctctccaaggtttattggagacctttatgctcatggttttattaaacaaataaacttcacaaccaaggttcctgaagggctaccgccaatcatagcggaaaaacttcaagactataagttccctggatcaaataccgtcttaatagaacgagagattcctcgctggaacttcaatgaaatgaaaagagaaacacagatgaggaccaacttatatatcttcaagaattatcgctgtttctatggctattcaccattaaggccatacgaacctataactcctgaagaatttgggtttgattactacagttgggaaaatatggttgatgaagacgaaggagaagttgtatacatctccaagtatactaagattatcaaagtcactaaagagcatgcatgggcttggccagaacatgatggagacacaatgtcctgcaccacatcaatagaagatgaatggatccatcgtatggacaatgcttaaagaagctttatcaaaagcaactttaagtacgaatcaataaagaaggaccagaagatataaagcgggaacatcttcacatgctaccacatggctagcatctttactttagcatctctattattgtaagagtgtataatgaccagtgtgcccctggactccagtatataaggagcaccagagtagtgtaatagat

SEQ ID NO: 66 - DNA, 165 bp, Rice tungro bacilliform virus
acgaatcaataaagaaggaccagaagatataaagctggaacatcttcacatgctaccacatggctagcatctttactttagcatctctattattgtaagagtgtataatgaccagtgtgcccctggactccagtatataaggagcaccagagtagtgtaatagat

SEQ ID NO: 67 - DNA, 2000 bp, Zea mays
ctgcaatatatacaccaaaagtattataaactgtcatatatatgaccaaaacctttttattttagaaaagtatattaatcatggtatattaatcaaagttgttgttggggctgcaaaaatcatacccttcttccacaagctgttccttgaactgcaggtactcaggaactctcagctcctcaacagcgagctcactgacgttgaccctcacatactcccagacaccaggcctagggcggatggcaagtgcaacccatggggggatgacaatcgcctcctgtaagataatagagctagaatgattaaagaaggtgcacactacaaaaggaacagtgctgtccagcgagatctgaatctgatgcaaacctgagctgccctcaggacatcctcaaaagcaccatccttgagcttctcgcgctcagcctcagggatcgcattgttgtactcggcaatgatctggtggggctgcagcataccctttccaaggtttttcagcctgcgcaaaacgatgtgccaaataacatcagactatgccagatctataaactcatcaaacatatacaatttcaagaaatagtttagacgtatgatcagcagtcagtagcgtgggaacatatgcaacatagcgaagaggcacaacagcaaattcattcgaaaaaatgaaaacaaagattcctctcttttaactgaacttctcgaaacccctttcatgcctacacatccgatctagtcagatgcctatgcgttcatgctgaacagaacgtgtcagaactaagcataaactggttagcaagcattatcgtattcgatagaccctttagtaacaagctatacattgggtaagttcagactccaatcattctgttcagaaacatcgtattgaatataaaactaaagaacacacatgcaggtgcagccagatctaacagcagtttacagtcggtactaaaaaaagcatggtgtatgtatgtatcatcagtatccagtactaggtttcgacaaaatcctggatgctaattaaatactcatcttattagggaacacaggaacattatgtctacagcattgaatgatggccacatcatgctagatctaacaatacataatatgatggaactggtcttaaaaagtcgcattcgctcaaataatacccgtagcaaaataaatgtaaacttgcagacgaagcgggggaaatgagggcagacctggtgaagacggcgacaagctcattggggtgggcagagagtgagtcgccaatgcgctccctgacgctgtggaggcggctcaggacacggtcacctgcaccttcccccattgctgtcctcttcctggatcctcaggcctgcacagcgaaaccgaaacggaagcggaagcttcagtcagcagagaaaactgaaaccgaaaaacggttcagatccgttgacataaaagctgcgatgacatcctaaaactaaaacccctccagcaagacataaacccaactgccaacaaccagtcttttaagtctcgacacacccttgacgctgcgccacgaaactatattgcaggcaagaaaccaacagaacctaactctggaaggggggaaagaaacggcagacaggagcaagacccaaaaaaaaacgactcagatcctggtactatagtcctagtacctagaccagaaagaagaaacaaccaatacaacaagaggcatacaagaactgaatcgatgaactgaaacgcttcagaggaccgaggaatggcggagaagggaggcgcctatttatacagatctgacgagagaaccgaacaaaaacacatcgatgggaaccatggagaagaaaagggctggccgcatggcaccaatggcctcggcctccaaaaagccgttgaatccaaagcaggcgaggacgaagcgtgacgcggcagggtacttctctagaaaagcacggcatcagcaaggtgggggggctggggttccttattgcaggcaatcacgaggtgattagcacaaacggaag

SEQ ID NO: 68 - DNA, 2000 bp, Oryza sativa
ctgaaatatacatcagagatattacaatgacatatatatcgataaaagaaaaataataaaattaagttttaaattttaagaatatatgtttttagtatcccaattatgcagatttcatacccttcttccacaagctgttccttgaactgcaagtactcggggactgtcagcaactcaacagcgagctcgctcacattgaccctcacatactcccagacaccgggcctcgggcggatggcaagggcaacccatggggagataacaatcccctcctgcatgataaaaaacaattacaagttaagttagagcaagcggtagagtaaagatggatctctgtgatgcaatgaaatctgaatctgattcaaacctgtgcactcctcaggacatcctcaaaagcaccgtccttcagcttctcacgatcagcctcagagattgcgttgttgtactcagcaatgatctggtgggcctgaagcattccctttccgaggttaaccagcctgcgcaaataacagtgtcaacaaaaatatcaggccagatctatcaactcagcctataaatatctcaataagataattttagcacttgagcatttgcgcataataagaaaatttgctattagccacttaaaaagaccatatatgatctgtttgcattgagatgaattaaaaatttcattgtagatatgaaatgattagttttgaccatttaattggacttaatgaaatatgcgcgataatcagatctacgcgctcgcgccaatagatctagtaagatgtaggttttttattttttttgtgaaactttgctaccacaacaagcatctgtaccagtgcagaattcattacttgtattcagtttgtaaaccgtatatataatataaataacatgcacatgcagtcagatctagcactaccagtccacagtaatccaaaactacatttgtatatttcatcattattcagtagtactaggtttgtacaaaatcttggctgcagaaggccgcacttaaatattcattctaatcagaaacttaaaaaaaaagtgactacaaaatgattgcatccaattcagtaaatatgagccattcctggccagatctaacaatctcaacaacaaagatcctatatgaacatctccttctaaaagaaaatacagtaacatctgaaggcagtagactagaaaccaacaaaatctaatgctgggaaatcactaaatcagcacgaacctggtgaagacggcgacgagctcattggggtgggcggagagggagtcgccgatgcgctccctgacgctgtggaggcggctcaggacgcggtcgccggcagcttcccccattgctctcctcttcctcttggctcctcaagcctgcgtgcacaaccaaccaccatcatcagatacatccagacccagtcaacacaatcactccaggaaaaaaaaaagtcaagccataaaccccaaccaaaaaccacgcctttgacaaacactggaagaaaaagaaaatcgcagctttttcacaagcaatctagaagaaaagaaaaagaaaagactacatagcagctataattgactgagaagcatacaggaatcaaacaatggagaaggggagggaggaagaacaatgatgctccaggctgaggaccgaggaactgggtgaagcggggtaggcgcgtatttatgcagatctgaggagagaaaccaccaaaacaatccgatggtttcaacgaaaaagatcgtcgcttcttgctgcaccagctcacccatagccgttgagatcgaagctaagctagcagcagcaaagctggaacgaagagtgacgcattcaagctcctctcctctcctctcctctcctccggagcacgaggccagcatgggatggattggggtttcttgttggccatggcaaaggaggaggtcattaacgttgacacggcgtaatttaattaaatcttatcttaaaatatgatttaagtggtagtaacaaggaagattaatactatgaa

SEQ ID NO: 69 - DNA, 2000 bp, Oryza sativa
gctgtttaagaaaaacagaagtaaaattcagtcactgttattttgcttcagttataatctgcaaatcgtcgttctggtacttactgtccatcaacaagctgttccttgaatgccaagtactcagaaacactcagctcttccactgccaactcacttacattcacccgaatgtagtcccagacaccaggccttggcctgatggccagtgcaacccagggcggcagcacaatggcttcctacatacagtcaaggaagtaagttagaaagactggtatttgactttgagttgactatcataaccatcctggctcattgccaaatttacctgagcagcccggagaatgtcttcaaagggagcatatttctctttgtcagcttcgatcaaggcatcgaactccgcaagcagctggtgacgctggagcattccctttccctggttaacatacctgcatagagtgatatttaagaaatagaaccaatgcttagatctcacatcctttctgcggctgaactatgttaatggcactaccacataaacctgatttttacttcttatttttaagaccacatgatctgtacttaatctagctatgaacaaacaatatttcaacatcatctaagattcatgactcaagacaaaaatgttagagctcatcacagattattatagataccatcattaaaactaaagagatgcataaccttgtcagctaagaatttgtaacatactaacatgttatcgtttcacatctgggttgactaagaactaaccaactgtatggataaaatcattgaaaactcaaaacaattagtagcaggttccaagaagacacaagatattatattgagatcttcacctagagaagagtgcaatcaactcattgggatgagacgagaaggtggcaccgaggcgttcgcggagactgtggaggcgagctagcttggcagccatgactcaatttcaggaactgcaaagaaaggttacacttagcaacacgtaccaaaaccactcacttgcacaagaataattagtcaacagccatcactaagcattgcaagactatctctgaacaggaaagccatgctaaatcaacactaataacatcacacaaaagcattggaagatcaaaacataactaaaaacagctgtttcatctacacaactgaaagcatctatggtttacgaagcagagtgcgagtactgattcaaaataaatcaacctgaaccaatatactctgacaatgttttcaaagggataaaagaaccagctttatcaaatggatttgttgggttttagtaagtatcattgagataccgatggcatatctcaaactttgcaaaattataatggcatggttccaaattaccctttagtattagcaccagttagatcctaattcctaaatccgataggacagagcgaaagatccctggagatatgaagatttggctacagattaagcagagccaacatgaagttccgaatattatgaatccgcaagcggggagatcaaagagaagaatacggaaggtcgcgactccatgaaagaatccaaccaaaaacccaaagatttttctcagttcaaaaaaaaaaaacccttcatttttggttcgccatccaccgacaggcaccaagacattcctcaggaagcaaaaaagattaagcagaacaagtgataagcaagacacagtatcaacggactacgagtcgagaaaatcactgaggcgcgattcttactgcaccaagtaaaaaaaaatttgggggcaaaaagaactctgcaatggggcggagcaacgtggcagcaaaactaaaggtcgaggatttgaggttttttgccggttttcctcgaaaccccgaatccgctcatagtaaacccactaaactgcagcagaaacccccctcttggttcagatttaccgaaagcagtaaacccaagaacatgtcagcaaaaactcctgcaagattcagctgacgacccaccaaagaatcgcaagaaat

SEQ ID NO: 70 - DNA, 2000 bp, Oryza sativa
tggcggacgcgccacgcacaaacacaaacctgcacacccctgtgtcagaggaggagaggccaagaaaggaaatcgagtggaggaagtgaggagcggcggagacgtaggaggaggagggggagatggaaatggaaagccgcgcgagagaggaggcgcgtgctggatgggaggaggaggaggaggtggtgggtttgtgtttggagagacgagcgagagaggcgaagcatttaaagggaggaagagggggagagagagagagagagagagagagagagagagagagagagaaaggaggaatataataaagggtggtgcacctgccaactgctatgctcaccaacactttgtacacacccagttacacccccctgcctttattatttccagtgcagtaataacttcaacaattattgaaatgaaaatggaattaatggagttagtatcggattagcgacacgcttgccgagcttctagacggtgcgattatttcagcgggaacgactttctgtaggtgaatttaatagaggagtgttttaaatccactcgacgttgtaatagctggtttaattcgtttgtactgtcgagtagttatccaaaatcaattttggatatttaaaagaaaaaaaaacagatccgaagtattggacctactggcaaataggaattttgctatatataggtgtgcgttcatttataatggagtagcatggagttttattaatccagtaaatgttttcattgatttaattaatataacgaatttcgcttgaggccatatttgttaaacgcttttatctctatcatcattcatcctaccagtaaagagcaccggagatcgcacttcatttaaatatatgtccatgttggataaaccatagtttattatagtgttcttttatatgttttgtggggaatttagattgtttaatatggcatacatatccatccatcattattatattctaacacaactggataagtgttctaaactattgtagaataactttgtagtatgatcgatcttgtggaataaaaaaagtctgacaataacctttcataaaggaatatgaatacccgtaatcaacgcatcaaatcattcacggtgtacgcctagcgaattcgttggcgagtgctcgtgcggccgtgggctcgctgtgatgcatgcatggctctctggctacgtcgagatagcgattagtagcaaaattaagcaagccacttattaattaatctttggagatatcatatgattaaggcattaattcgtacgtactcgtcgtcagcgttttctgcaaagtccactacagttttttctttctttgctgaaaatgctgatgtgttggagatggagtgacgtgcacaacctgccgccacgtggatggttgctggagcctacgtgtcatcttaatttgaacaaaaaaaaaagaggaataatacatcaatacattttcgaatttcagttctgccattgaccagtaatacacatgtcggcctcacattttaccctgatcttagtaacgggtggtcgcctggtcggtcactgaaaaaagttcaggaaattatagtcaaactgaaacgaacatattcactccttaaaaaaactaaatctttttatatatttgtgatattgtaaaatagctacgggataatgatatagatatatatagtgataagggatagatggatcgagatatggagttgtgctttctttaatttccactacttgggctaccatattatggtagttggtatgaaaagatacacagcagtatagtgatgtgatcaatgacatgtatatctcacatgctcccatgttggagtcaaattttgctagactaaaatccaattccaagcagtccctagccaagaacaaacaaaattcagtgaggtcactgctgcaccaaggactgcatgcatgcaggagaagggcattttctcttttttcttttggagactcgattcaattcggtcggtcggtcgcaatggtcagcttaattaaa

SEQ ID NO: 71 - DNA, 2000 bp, Oryza sativa
tgtgaaaggtggcggcaccagcttagccgcagcttctctcgtcgtctccctgaaacgagagggaggaagttggtagcgtgatatatttaggcatgtcatctcttgtataagaagtcttatctgtgctaattcacacggttctctaatctctctccattctgtttttgtaaattggttcagtagatagcgtagggttatgcttatatatactccgtgaagtatatatttaaaaattagtcacacgtaaagtactatacatgttttatcgtctaataacaataaaaacactaatcataaaatttttttaaataatacgaatggttaaacgttgaatatgaaccgtgcaaaactatatttattttgtaacagagaaaatatttcacattaattagattgttgttttatggaaggttggagagctgcgccgccgttgcgcagacctaggaggctgcttataagttataatcaatcaattcacggatgccggctgggacgcggcccatcgtccgggaagacgacaactcaacgcaaaaagccgatatgcctccaaattgccattgccacctctacggctgtttatactgctccaaatcaaaagcgtccatggaagaatctagtatttcccgcaaagacgatgatgatatgcaggattggatatatagggggttgttgcatgattgctagaactcccgtttccgaagttgttcgtccatttttaaagctgccaaataggaatttattttgttttcaagtgtaatagagttctgtccagatgagtgaattataatttggttcacattttatttgctaagtttcagtttgaacattctcaaataacttttttcttcactttttaaccgagtaacttagttattttttccgtttggaccacccaacaatttgttgctaagtgcatctcacccgtcaaataattcctttgaatccaaattcaattatatcccaaaaataaaaaacttctgaattccacatcaattcaaaccccaaccattttaatttctctccatattttccatttctctatttttacctttctcttttttccatctatttatttttttccttttctatttctttctttctccttcctttctctgtttccttcttcttctcctcggctaggcccgagccagcccgtgccgcctcgcgccaaccctgtgccgccttacgccgcgcttgcgtgcgctcgcgcccacctcgtgcccaacccgcgcacgccacacgcacacacgaggacgatcgacggacgaatgcaatcatatccccttccttactcagctagaaggctcaagaaccgcaactttgatctcttccaccctctcaaatccgccccaacccctgctgactcaatcgccattaccggaggaaaaatccccgaaaccctattaccggcgccactaacagagctccaaaattcgtcgcataattcgaaaatattctgaaattgaaggtaaaaatggaatctacatgcgaagtactccctttcccctccaatccgtcactggaacgccgccggcgccgcctcccgctgccactgccctgtttggccgccgacagccgcacggcgcgccgctgctccaggccgccctagcttcaaccaccgccacctttggctccgcctccctcctcttatgctcaccaagcccgcctccctcgccggagatcgccggaaccaccgccgccatggccgccaccgcctcctgcttctggccgccgccgccagcctcgccaccggcgcctatgccaccgccgaccacggaaacggagtccctacaccttggggaccacaaaaccggcggcatccctcccaaaaccggcctcctccaccgccggcgttcgtgggattccggccagttctgtgcagagcgagagaagaagaggaaaaatagattttcctattgaaagataaatcagaaaattcctttttcttttcctatcaagttgaccatccgtttgacctcaaaatcaaaatctgagaccta

SEQ ID NO: 72 - DNA, 786 bp, Zea mays
gacatggaggtggaaggcctgacgtagatagagaagatgctcttagctttcattgtctttcttttgtagtcatctgatttacctctctcgtttatacaactggttttttaaacactccttaacttttcaaattgtctctttctttaccctagactagataattttaatggtgattttgctaatgtggcgccatgttagatagaggtaaaatgaactagttaaaagctcagagtgataaatcaggctctcaaaaattcataaactgttttttaaatatccaaatatttttacatggaaaataataaaatttagtttagtattaaaaaattcagttgaatatagttttgtcttcaaaaattatgaaactgatcttaattatttttccttaaaaccgtgctctatctttgatgtctagtttgagacgattatataattttttttgtgcttaactacgacgagctgaagtacgtagaaatactagtggagtcgtgccgcgtgtgcctgtagccactcgtacgctacagcccaagcgctagagcccaagaggccggaggtggaaggcgtcgcggcactatagccactcgccgcaagagcccaagagaccggagctggaaggatgagggtctgggtgttcacgaattgcctggaggcaggaggctcgtcgtccggagccacaggcgtggagacgtccgggataaggtgagcagccgctgcgataggggcgcgtgtgaaccccgtcgcgccccacggatggtataagaataaaggcattccgcgtgcaggatt

SEQ ID NO: 73 - DNA, 1160 bp, Zea mays
atgtgctggtgccccataaggtaggcacctaggtctgtgtttgaagcatcgacagatttgtaaacatgttcctatgaacctatttctgattgataatttgtcaaaactcatcatttgtcttcatccttgcctgcttgcgttcacgtgacaaagtacgtgtatgtcttcggcctttgctgtgtatgtttcgcattgcttagatgtggtgaaagaacatcagaagatgcattgatggcgtgcttaaaccagtgatgtgctccaggtgttcctgcagtctgcagagatatttactcttgtagtcttgttgacagcacagttgtatgtgatttcttggatgtaatgtaaaccaaatgaaagataggaacagttcgtcctcttccgtatacgaaggtcactgtatcatttgtcgtggcacaagatgatctgcaggcaggactgcaacatggtttcttggactgtcctgaatgcccgttcttgttctttagttgagccagagcagcagcctggtgtcggtgcctgagacctgacgaagcacacggcaaacaaacaagtcgcagcagctagcaggggcgttgccatcgccacaagcccccaagagacccgccgaggaaaagaaaaaaaaactacggccgccgttgccaagccgagcgtgcgaaccgatccacggatgggagatcagagatcacccaccgcaggcgggcggcagtggctggcgaggtgcgtccacagaacctgctgcaggtccctgtccgtcccggcgaccccttttctaggcgagcaactccccatggcagagctgcacgcagcagggcccgtcgttggttgcagctttaaccctttttgttttaaccatacaatgcagagtcgcagaggtgaaacaggacggaaattacagaaaagatggtggtgtgccagcagccccagcatgaagaagatcaggacaaaagaaaagcttgtgattggtgacagcaacaggattggattggagccaagctaggcagtgagaggcaggcagcaagacgcgtcagccactgaaatccagagggcaacctcggcctcacaactcatatccccttgtgctgttgcgcgccgtggttagccaggtgtgctgcaggcctcctccttgtttatatatgggagatgctctcaccctctaaggt

SEQ ID NO: 74 - DNA, 1532 bp, Oryza sativa
tagtcctctaatatatgaaattttgatataggtaaagaagggtattgcaaggataagaatgtaaaaagaaataagagtaatccttaccgataatagtattccttctctaccgttaaaagttaaacctgtgcgtgtagcattttaatccaggatctatcgaatccgtccctcgttggcgtgggcgacgaacacgtgcagaagaagctttccccagaaagcacctcaccgcctcgccgtctggcagactggcacgcggggccctaccctcgctgcgcctgggcccgtccgccttctgcacactgtcacgcccccacccgctcgccgcctcgcgcctctctctccgcctccgccgcggccgcccgacgtgatagcgacacgtaggactcgccaaacacaaaaaatccatcgcgatttttggaattttgttacaaaccaaatcccgcattagagatttaatttgatttaatttaattacgtaggagtaccagataaggagatcgagttaaaaaagctaacggcgcggcgtggttatctccgaatcggctgtggctccccgcgtcggcgtcggcgcggcggcggcgcgccggccgaaccctggccgtcggatcgggcgtcgtcctgggccccacgcgccacgggcggctgtcgtttgctcctcggagcggggtgggcccaccatggccaccaccacaggtcgcggtcgcggctgacctggcggtggtcccgtgctcgcggtgttttttttttttcactctctttctctcggtggacagtagcgggggccgcggcccgcgggggcagagattgcaaaaacagcggaaacggaagattgcaaaattgcaactgctttcctgtttttaattcgggatcaaaaagattctttcgtcggggtccccgtgccattgttgtattgcgcgtaggtccttgcttgtaaaagataatctccttaattttttctttgtactactagtgtatatgcagtaagaatataccatgagtaaaatgaaccacaaaactaattacgatataccattctcatgtagacgttctcttttcttttgctagtcatacgtgcatatataaccaaacaaaaaaatgtttgaagtactcctatccaatttattactccagtagacaacaaaagaaaatgtttgaagtaataactgatccatggtacagtagggttgtcgtcaatcttgtgtttctttcattccattgtacttacaatcgtactccagctagcacagcacaatgggcttaagctttggaccccaaattctgatcttgtcggggacccgtacgaaaatactcccgtagagatgcagataccgtcacaacctacaaccaacgaatgttaagaaaacaaagggaaaaaaaaagaggcgaattcggaggagaaaaaacggtggctaaaatatagtgcgggtgtggggacgcgacgcgagcgacgaaagaggagagaggatgggttggcctgcccccccctcccctgtctataaatgcagaggcgccgagtgccctagtcgccgctc

SEQ ID NO: 75 - DNA, 841 bp, Oryza sativa
tcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccct

SEQ ID NO: 76 - DNA, 1392 bp, Oryza sativa
ctcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgattttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacaccccggcactatcaccgtgagttgtccgcaccaccgcacgtctcgcagccaaaaaaaaaaaaagaaagaaaaaaaagaaaaagaaaaaacagcaggtgggtccgggtcgtgggggccggaaaagcgaggaggatcgcgagcagcgacgaggccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcgtccctctcctctttctttctccgttttttttttccgtctcgtctcgatctttggccttggtagtttgggggcgagaggcggcttcgtcgcccagatcggtgcgcgggaggggcgggatctcgcggctgggtctcggcgtgcggccggatcctcgcggggaatggggctctcggatgtagatctgatccgccgttgttgggggagatgatggggcgtttaaaatttcgccatgctaaacaagatcaggaagaggggaaaagggcactatggtttatatttttatatatttctgctgctgctcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagatggctgacgccgaggata

SEQ ID NO: 77 - DNA, 743 bp, Oryza sativa
gaattcccggacctccatgcctacatcaactaatttgattccttgagtttacgtttagtgatatgtctatttttagagcttgttggggcttcggcctcagctctagccagccaaacatgttctaccaagtaccctatgttggcatgatatagtgatgcattataacaataaatgagcgagggattgctggctgaaaaagctatactagctgcatttggttatagttaaccgaactattaattgcgtgtacaacaaaataaaaaaaatgcatgttgcacattctttcattaacattatgttttggtagtgtgaattagaaatttgattgacagtagatcgacaaacatagtttcaatatgcttaagttagttatgactttaacatatcagtctccttgatattttcgttttagattcgtctctctactagtgtgtatgtccaccttccatagcagtgaagggttccattccatccctggtaaaaaaaaatcaaccactactatttatttcctaaaaagcaaaatgataaaatatcatttttttaataaaaataaaaaaattttggggtacataattgatgttgccccttgggattaaccttaaaaaagggcgaattttctagggtttggccaagttttgcaatgcaccaaattattccccttgggccggccgccaccccaaaaaaaaccccaacccccaactttccattgaaggccgggcccccttaaatcctcatccccccaa

SEQ ID NO: 78 - DNA, 144 bp, Oryza sativa
taaaaaagggcgaattttctagggtttggccaagttttgcaatgcaccaaattattccccttgggccggccgccaccccaaaaaaaaccccaacccccaactttccattgaaggccgggcccccttaaatcctcatccccccaa

SEQ ID NO: 79 - DNA, 612 bp, Cauliflower mosaic virus
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagg

SEQ ID NO: 80 - DNA, 837 bp, Coix lacryma-jobi
agcagactcgcattatcgatggagctctaccaaactggccctaggcattaacctaccatggatcacatcgtaaaaaaaaaaccctaccatggatcctatctgttttctttttgccctgaaagagtgaagtcatcatcatatttaccatggcgcgcgtaggagcgcttcgtcgaagacccataggggggcggtactcgcaccgtggttgtttcctgttatgtaatatcggatgggggagcagtcggctaggttggtcccatcggtactggtcgtcccctagtgcgctagatgcgcgatgtttgtcctcaaaaactcttttcttcttaataacaatcatacgcaaattttttgcgtattcgagaaaaaaagaagattctatctgttttttttttgaaatggctccaatttataggaggagcccgtttaacggcgtcgacaaatctaacggacaccaaccagcgaatgagcgaacccaccagcgccaagctagccaagcgaagcagacggccgagacgctgacacccttgccttggcgcggcatctccgtcgctggctcgctggctctggccccttcgcgagagttccggtccacctccacctgtgtcggtttccaactccgttccgccttcgcgtgggacttgttccgttcatccgttggcggcatccggaaattgcgtggcgtagagcacggggccctcctctcacacggcacggaaccgtcacgagctcacggcaccggcagcacggcggggattccttccccaccaccgctccttccctttcccttcctcgcccgccatcataaatagccacccctcccagcttccttcgccacat

SEQ ID NO: 81 - DNA, 947 bp, Oryza sativa
aatccgaaaagtttctgcaccgttttcacgtcctaactaacaatatagggaacgtgtgctaaatataaaatgagaccttatatatgtagcgctgataactagaactatgtaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagatatttttttttaaaaaaaaatagaatgaagatattctgaacgtatcggcaaagatttaaacatataattatataattttatagtttgtgcattcgttatatcgcacgtcattaaggacatgtcttactccatctcaatttttatttagtaattaaagacaattgacttatttttattatttatcttttttcgattagatgcaaggtacttacgcacacactttgtgctcatgtgcatgtgtgagtgcacctcctcaatacacgttcaactagcgacacatctccaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagag

SEQ ID NO: 82 - DNA, 721 bp, Mirabilis mosaic caulimovirus
tggagattcagaaaaatctccatcaacaaataatccaagtaaggattaatggattgatcaacatccttaccgctatgggtaagattgatgaaaagtcaaaaacaaaaatcaattatgcacaccagcatgtgttgatcaccagctattgtgggacaccaatttcgtccacagacatcaacatcttatcgtcctttgaagataagataataatgttgaagataagagtgggagccaccactaaaacattgctttgtcaaaagctaaaaaagatgatgcccgacagccacttgtgtgaagcatgtgaagccggtccctccactaagaaaattagtgaagcatcttccagtggtccctccactcacagctcaatcagtgagcaacaggacgaaggaaatgacgtaagccatgacgtctaatcccacaagaatttccttatataaggaacacaaatcagaaggaagagatcaatcgaaatcaaaatcggaatcgaaatcaaaatcggaatcgaaatctctcatctctctctaccttctctctaaaaaacacttagatgtgtgagtaatcacccacttggggttgtaatatgtagtagtaaataagggaaccttagggtataccattgttgtaatattattttcagtatcaataaaataatctttcagtttatcttatattcatttgtgtgacaccgtattcccataaaaccgatcctaatctctcc

SEQ ID NO: 83 - DNA, 352 bp, Peanut chlorotic streak caulimovirus
acagagggatttctctgaagatcatgtttgccagctatgcgaacaatcatcgggagatcttgagccaatcaaagaggagtgatgtagacctaaagcaataatggagccatgacgtaagggcttacgccattacgaaataattaaaggctgatgtgacctgtcggtctctcagaacctttactttttatatttggcgtgtatttttaaatttccacggcaatgacgatgtgacctgtgcatccgctttgcctataaataagttttagtttgtattgatcgacacgatcgagaagacacggccatttggacgatcatttgagagtctaaaagaacgagtcttgtaatatgtttt

SEQ ID NO: 84 - DNA, 1648 bp, Sorghum bicolor
cactcgcacatctcatggtgtcccaagaacggcaagagccagcactgcctctgcctagcaacagcagcagcgccaagcgagcagccgcgtccatggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgcggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttccacgacggcgccgcgtcgcccgtcgtcgtggactacttcaccggcaccctcggccaagatttcgagccaatggggcgggtgtaccagaggtactgcgagaagatgaaggagctgtcgctgacgatcatggagctgctggagctgagcctgggcgtggagcgcggctactaccgggagttcttcgaggacagccgctccatcatgcggtgcaactactacccgccgtgcccggagccggagcgcacgctgggcacgggcccgcactgcgaccctacggcgctgaccatcctcctgcaggacgacgtcggcgggctggaggtgctggtggacggcgagtggcgccccgtccggcccgtcccaggcgccatggtcatcaacatcggcgacaccttcatggcgctgtcgaacgggcggtacaagagctgcctgcaccgcgcggtggtgaaccagcggcaggagcggcggtcgctggccttcttcctgtgcccgcgcgaggaccgggtggtgcggccgccggccagcagcgccacgccgcggcagtacccggacttcacctgggccgacctcatgcgcttcacgcagcgccactaccgcgccgacacccgcacgctggacgccttcacccgctggctctcccacggcccagtcccagcccaggaggcggcggctccctgcacctagcgagcgagcgagccgggccaaacaaacaaggggcaaaggccatctctttcgccggggcccgcgcgcggggttcgcccacgtgcgcgcccaggtgggcgctggccgcgggcaggtggcggacatgtggcctgcgggccccgcgccgccttcccatttttggacgctgccgcgcatgccgcatgcgtgcgtcgacggccctactacttctactactgctactgcgactactagtgtacatacgcaaaaatacatatatacgtattttctatatatatatatataagcaaggcggccccccggtgaccttttctttgtttttgtcgacaactgtgttttgatcccattctagctgttctatggaccatggatggttcgttcaatgtttgtacgta

SEQ ID NO: 85 - DNA, 1242 bp, Sorghum bicolor
atggtgtcccaagaacggcaagagccagcactgcctctgcctagcaacagcagcagcgccaagcgagcagccgcgtccatggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgcggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttccacgacggcgccgcgtcgcccgtcgtcgtggactacttcaccggcaccctcggccaagatttcgagccaatggggcgggtgtaccagaggtactgcgagaagatgaaggagctgtcgctgacgatcatggagctgctggagctgagcctgggcgtggagcgcggctactaccgggagttcttcgaggacagccgctccatcatgcggtgcaactactacccgccgtgcccggagccggagcgcacgctgggcacgggcccgcactgcgaccctacggcgctgaccatcctcctgcaggacgacgtcggcgggctggaggtgctggtggacggcgagtggcgccccgtccggcccgtcccaggcgccatggtcatcaacatcggcgacaccttcatggcgctgtcgaacgggcggtacaagagctgcctgcaccgcgcggtggtgaaccagcggcaggagcggcggtcgctggccttcttcctgtgcccgcgcgaggaccgggtggtgcggccgccggccagcagcgccacgccgcggcagtacccggacttcacctgggccgacctcatgcgcttcacgcagcgccactaccgcgccgacacccgcacgctggacgccttcacccgctggctctcccacggcccagtcccagcccaggaggcggcggctccctgcacctag

SEQ ID NO: 86 - protein, 413 aa, Sorghum bicolor
MVSQERQEPALPLPSNSSSAKRAAASMDASSPAPPLLLRAPTPSPSIDLPAAAGKAAAVFDLRREPKIPAPFLWPHEEARPTSAAELEVPVVDVGVLRNGDRAGLRRAAAQVASACATHGFFQVCGHGVDAALGRAALDGASDFFRLPLADKQRARRVPGTVSGYTSAHADRFASKLPWKETLSFGFHDGAASPVVVDYFTGTLGQDFEPMGRVYQRYCEKMKELSLTIMELLELSLGVERGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRQERRSLAFFLCPREDRVVRPPASSATPRQYPDFTWADLMRFTQRHYRADTRTLDAFTRWLSHGPVPAQEAAAPCT

SEQ ID NO: 87 - DNA, 12906 bp, Sorghum bicolor
cactcgcacatctcatggtgtcccaagaacggcaagagccagcactgcctctgcctagcaacagcagcagcgccaagcgagcagccgcgtccatggacgccagcagcccggccccgccgctcctcctccgcgcccccactcccagtcccagcattgacctccccgctgccgctggcaaggccgcggccgtgttcgacctgcggcgggagcccaagatcccggcgccattcctgtggccgcacgaggaggcgcgcccgacctcggccgcggagctggaggttccggtggtggacgtgggcgtgctgcgcaatggcgaccgcgcggggctgcggcgcgccgcggcgcaggtggcctcggcgtgcgcgacgcacgggttcttccaggtgtgcgggcacggcgtggacgcggccctggggcgcgccgcgctggacggcgccagcgacttcttccggctgccgctggccgacaagcagcgcgcccggcgcgtccccggcaccgtgtccgggtacacgagcgcgcacgccgaccggttcgcgtccaagctcccctggaaggagaccctgtccttcggcttccacgacggcgccgcgtcgcccgtcgtcgtggactacttcaccggcaccctcggccaagatttcgagccaatggggtaagcgaagcaccgatttacatttaccgcgcgtcggcccctgaggcctgggtcttagtcttagcactgcatatacggtcggtagctctggatatgatacgtatatatgaaaccccgttccaatcccatgcacggtgtacacaggcgggtgtaccagaggtactgcgagaagatgaaggagctgtcgctgacgatcatggagctgctggagctgagcctgggcgtggagcgcggctactaccgggagttcttcgaggacagccgctccatcatgcggtgcaactactacccgccgtgcccggagccggagcgcacgctgggcacgggcccgcactgcgaccctacggcgctgaccatcctcctgcaggacgacgtcggcgggctggaggtgctggtggacggcgagtggcgccccgtccggcccgtcccaggcgccatggtcatcaacatcggcgacaccttcatggtaacccctgctctgttttttcttgtcctcctcttgtcctgtgtgtgtgtatattcacttctctctgtttttttgccccgaatcctagtggacctaactggacggattacagcacgcacacgtaggcatgtcatgtagcagcagtctgcagcactgtagtacttagcgatgcaatagagacatgcgttccagtcggttccatctcggtgggctacagctacagtcctacacggacgcggctcgtagtcgtagggacgggcgcgttctctgtatccacacacggctgcgcccaggccgaggcttccgccgcgggaaagttgcgacaacagaacggggtttgtgccgttggagcgttgcggagaggcagaggcttggggggacgggggcgcgatacgctgcgatgggtgggtgaccgaggcgacgctttcggcgggggcccgggcctgcccaggtgcgcgcggcctcgtcgccttcccctgtttttttgatgccgccgctcggtcctcggtgttctggctccgcccgcccgctcgctgggtgcccatcccatctgatccgatccgctccgctccgcggtggcggtcctatgcgatgccgccgcacgagcgcggggggccgcccgtggaggagtagaaagtggtacaaggttggttggaacttggaattgtggggggttactgctgctggtggctgctgctttgcaacttgccaggctgctgcctgttgccccccgcgttttctagccgtttccgctcgcgatccggcacgcggcgcccacaccggggctccagctcggccccttggccgtgtaggtagcaggcacttgcatctgtccgttcgacacgatgattcttgtgcactgtgtacgtatgtactaaccctttctggtatgatgtacgcatggcatgcaggcgctgtcgaacgggcggtacaagagctgcctgcaccgcgcggtggtgaaccagcggcaggagcggcggtcgctggccttcttcctgtgcccgcgcgaggaccgggtggtgcggccgccggccagcagcgccacgccgcggcagtacccggacttcacctgggccgacctcatgcgcttcacgcagcgccactaccgcgccgacacccgcacgctggacgccttcacccgctggctctcccacggcccagtcccagcccaggaggcggcggctccctgcacctagcgagcgagcgagccgggccaaacaaacaaggggcaaaggccatctctttcgccggggcccgcgcgcggggttcgcccacgtgcgcgcccaggtgggcgctggccgcgggcaggtggcggacatgtggcctgcgggccccgcgccgccttcccatttttggacgctgccgcgcatgccgcatgcgtgcgtcgacggccctactacttctactactgctactgcgactactagtgtacatacgcaaaaatacatatatacgtattttctatatatatatatataagcaaggcggccccccggtgaccttttctttgtttttgtcgacaactgtgttttgatcccattctagctgttctatggaccatggatggttcgttcaatgtttgtacgtactccacgtaaccaaactactctagtggactagtagatcgggctcatgtgatgaaactggaccgacgcggacgtcacgtgcgtcacccgcgtctggtagcggtagcgcacgagcgccgaatgtttcctgggcccgcaagagaatcgcttctcatctcctctcaccatgaatggggaaaaatgctgcgtcgaaagttccagacgtttccaaattccaaacggttttgtggcgtccgatccatggggcgccccaaacttccaagacgttttcaggttccaaatcttcgtgctccacatcaccttcttcccagattcatttgcctcgtcgcttgctctcctgtgttattcacgggtcccactgttgccccgtctgcgagaaagaaatttattagagttgaagcattcgacatttcgactgactgattgttagtatcactaaattttgtgcacatgtttctttggtcattcatctctggatattttttttagataatggatataaatatcgggcctctacatctgaggaagtacacagccaattattttcatctctggacatgggacgatggaagaggcagatagatttaggagacccttcaattcagaatttcaggtgcacaaggcctgcctggcttgcccggattcttgtttcggacatgaccaactaggccgcactacttgcactgatagctggagaaaaaacaaaactttgcaaacagcaggattatctacaagggaaactccatccacgtgaaccagcatttcagggagagatgcgacaaaaaaaaagaggcggcaacaaaaaaatcttactgcaattttatctctgcattgaacctcttccaaccatgccgcatcctgtactgttttgtatctttcccggtggtccgttgcgttctcacgcagttgataacatgcagtcacgcaccaccgaatccagtgtactaggggtagtgacttgtcacgcggaacaacaggtcggtagcaccaagcaagtcgctgtagacttgggcgtttaacaacgacttgcacaacagttcaaatatagcatatgcaattatgcacaagattgttcgactgctatccgacaaactgaagaagctgcccaattgaacagaatgtaccagtgatttccagcacactatcttacagcagcgttgagaatgaaacaacaaatgggggaaaacagatgtgtattattctacagttacaccaaagagtttgtcctttcagcatcaacaagaatcatatgcatatctagtgacaaaaattcctctaattttaccctacttggtaacagttctcttcaacacatatatttcacgtgcttgcatcgagttccttgggccgccacatcgacttctcgacgcaaagcaagccctcgttgcccttggtgtaggtcattcgcacctcccactgcagggacttggccatgctttccagttcgtttattgtgtccgcagtgtccctcacaatcagtttgccttggggcctcagtacacgatcaacctcggcaaaaactgccatcaatttgcatctgtaaacaagcaacacagatttagcatctgtaaacaccacaggtttcattgcaagaagcataaagcatgcaaacatgctacttgtacatgtcaaagaaacatgtcaaactcaaacacatgaaaatcattattattgttttcttgctgaactgatcacattagttggtttcaatttctgagttccactagtaatctataccagaaggatagaataatgtcaagaacaagagatacaaacctctttgtgagctttgagaatagatggtccgcgtgcagaaggtcataagttcttgggtaagtgctcaaagactcgcaccagtcatggtacataccaaacaaaccacgctcgtaaatgatgggcagtgtgtctggtgaatcaatcggcacaatattcatgacccagaccttttggtccctcagagctgcagcaaaactgccatgcaacgatgtaaagcattagtaaaaatattgggttttttaaaccaaaaccaagaaagataattcctccagcttaactgaaagaaagaaagaaaaaaactgcttaatgacttatggtggacaagttgcctgttatgttttatgatagctatgtgccagcttggctaactggtagttatgtagtgtgatctgaattaccaaaaaagagaagaaaaaaaaatcatgcccaagaaactgagaaagacacccatttacttaccctccatacacagctctcatgtccattacatttctcactttggaccagtcaattcccatgccattcacatacgatttacttacaacccttttccagtgagcattatctgcctcgaaatcttcatttgcaggctttccatagaccccaaccttggaaccatcaatccagaaaggagtcttctcaagcctttgtggccaaaactctggccattttgaccctcgaactttcgagccaacaggcagtttgtgcatgcatgcttccaaaggtacattcctgcaaatcaaaagattgtgtaagcaaagcagaggaagcacttcgccgcattgaaaatacgttcttctcaaagaaacaaaaccataccaagctgcatctgcatcatcagattccttgcacaatggtgggttgttttcggatcttttctcatagcaaatgttgtccattggtttctgaaatatgaccataccaacttgatttaacttatccttagtcttgttgaccatcttccagcacatggactttgtcaaagtggacatcgctgaaaagattaaggggtcatatgttatgatagaaataaaattcaattttgcactgttggtacatagcatctgttttgaacaaatgcaatccttccttatccatgaaagaagttaacccctgatacttaggattattcagtactttcactcatgaactgctgaatttgttctgccagtagttgctatactagaaatgttcagtgtaccaaacataaatttggtacgggttccttattaaagatgggaggctgtatggtatttcgacgtaacaaatcaagttagcagctaccctacttatggatatacacttctcaaaatgaatatacatagttttgataggtgacattaattaatataagaacttcatgcagttagggtgaaactaaactaagcagttacggaaataccattccaaatctcaacatcctctgggagcttttggtaaacaggagtggcagaccagacaaagtaaccaccagggcgtaacaagcggttcaattccagcaaaagcatgccacctaaaaggagtcagtaataagattcagttctatagcaaatcaataaatgaaaggaagacatgtcaccaacaagacaaaccttcaatgtgccaagggaccctgcagcgagcgcaatgaatgacatcaaagactctgctggggtatggaagtctcttggtgcccatcacagctgatattgctggaattcccctttctaatgcaaattgtacttgagcttcatgctcatctttcggagcaaaagacatggtaagcacatctctatcaaacatgtagcctccaaagctggcaactccacaaccgacatctagaatgacgcggcttcgtttgccccatgcaatatcaggcagtgcctgtgaatgacagtttaatcagcatatgatgaaagcaagtgtgataatatcaagttcaaagatgcaacatgaaactttcataatcatggacagtactaagcttgcttgatagattaatgtatggatgagactaaaaaaaaggaaagttgtatccatcagaacgagaggctgaaaacacatggctggctgtgaaagcctgatgtcgtttagtctagcataaacaaactgtcctcagcatgtagatttccatagggtggcatttgacaaattatgattgtggactagcgaatcaatcactgattctcaaaagtgtgagacagatgagttcaagtctaaggggtgactaatatgggatgctgggatgatgatgatgatatatacctgctgaatagtatcaatatagtggagggcaccattcttgaactgagtcccacccccagggaacaggaggtagtcacctgatactttaacccaattttgatgtcccttgtactctgcgagcctagtgtgaggaacattgctgtaccatacctgcaaaaagcagcacaagatggtaataagtaaacagagatcttggtcagctaaagatgattcagtgtcgtacaatttagaatagacagaatcaccttgtccctgctccttggccactcaattgggcgtttatatccttctgggagtggaacaaggcaggtaggaggctcctcagggcaatgcctctcacgatgttcataatgtttagtagttcgaagcttcttgatagccttctcgttgtcaaggcaaggtatgtaatctgtcgaggcactgctattacatagtttccaggaatagctagtcgcatcacctgaagactttgatgacgcttggacttccttttcattcttggactctgcagcctgtgtggggaatgaaccattctgggtatttgactccttcagaagctctgattgggccccatcaggaaatacctcgttggagtttgagctctgatccttctctccattttcttccaccttctcttctatctgaggttgctcctcctgagtggcatcaccttcaggcttctcttcttgatcatccttgctctctccatcaggtttttcatcaccactctcatttgtgatttcatcatctttcttctccccactcttctccccgtcaccatcgttcttcatgtcatctgaccgcccttctgattttccatttgcatcatcaaacatatccttggtctcagctttctctgtcggcacttccggctccttctcttcaggcttctcctctggcttctcagtgaacttctcttccatcgtggcatccttgttattcggctcctccggcatcgtggcatcattgttgtcggtgtcctcaaatttctcagaaccttcaccagcattgtcctgtgaggccccaaaattgacaggcgcaggctgctgcttcaccaccggcttcttattcgaggagatctccagcgggaagacagtggacgaggtcatcatccacgcgccgaccaggcagagcgccacaaagacgacgaccgtggtggtcgtgcagaacgacgacgacgtcgaggacggccggcggccgtccatcttcccacctcggccaaatgccattagtgcctggcgaacatgtaccagagcaccgaccttcacgcgatttatctccaccaactactgctggaccaagaacccccaaaaaaatcgcacctttgtctgctttgtgctgctacagccgcgcggcacctgaagcaaaccacaaaaaaaacttaaatcgccgcggacataaatcaaggtgctggatctaaagaacaaacgctggatctactcaagcaacaacggaaggaagatccgctattggtgctagtattagcttcttgtttcctagtactacagcggctctttcccagtataagaacacgggaaaacgcggagaaatcccccttcgtggccaaacatggaaagaaaattagtaaagcgtgtgctttaaaaccccctcgttctgttccttccgcggagagctaccgcatcttccaattgagctggttctcagctgggcgcaaaacgcgcactaatcaatgtccgattccatccacaaagaaaaaaaagacgggaacagctaatccagcagctcgctcgctagctagctagctcatcggcggaaggacggaaccagctttgctggatccaggacagcaagagtgtgcaaggagaaagaacggagcagcaatgcggattgcggaggcggtggattggtacctcgccggaaccgaccggagtggtcgcggtggccctccgcgcggatctcgaagaggagcgaggaaggggaaggcggatgcgcgtccttgggttctctgccaccgcactgggcctcgccgcgttataaaggcgggcgggcgggcgggcagcgcagtgtgagtggagtgcaatctgttgtgtagtgtgtgaagaggcggaagcggaagcggaggagatgggttcgcattagacgaccgtacgtaattatacgctatactagtacttgggttagattactcgggagatcttggccaaaatgtccggtctgagtgtttggtagttttatggatttgcccttttaagatgttggtatttctccgggagcttagaaagaagaaatggcgatgctttaggccttgtttagatgcgaaaaaaatttggatttcgctactgtggcatttttatttgtttgtagcaaatattgtccaaacacggactaactaagattcatctcgcgatttacagttaaactgtacaattagtttttattttcatttatatttaatgtttcatggatgtgtcgaaagatacgatatgatagaaaattttgaaaactttttagttattgaggttaactaaacaatgccttaattgagaatttactcgagcaaaaagagttaggtcagtctcagtggagagtttcatggtgttgtttccaagactgccatatcatgtgaaatgaaatgaaacttggttgaaacactcactctcaatggagagtttcattttatagtttcatgggcatttaatttcaatactcatagagagttgatatcgtgccaactcatttcttctctctcttcttaaatacacagtcatatcatcaaaaaaaatcctatgtagcaacatatttaatgcaaataaaactcatatggtggactgtaggagtagcattaggccaagggcacacacacggtcacggtgtgagtgcgacggtgcgagtgggcccgcggcggtagtaagtgcgtgcgcgcccggcgcccccctccgcggcgacgacgcagcggcagcgcgtcgtccagtgcaccgtctgctgttcggcgctgcgggtcctccgcgccacggcgcagtgaaccgggcgcgtgcatcccgggagcggcggcttggcactcccctgcttgtcggtggcggccgtcggcatcgctcggccccggagcgtcacgaggctgctgattgggagcgagagcgagtagtggggctggttggggacaatcccattcccacccggcccaccaggctgggactggcccactagtcactagtgggtggctcatgggtgtgggtgggctggctaatgccgcctgcccaacaaccaacccaacccctgtggacgctggtaccggtagttgccgcgccatggtggactgctgccgcctgatgcctttgcctgccacgctccacgagttgaggcgcaccaaactgtgctgtgctcctgatttgtgctaatcggccgacgcgtaccattctttctttctttcgtctacgcgcagagaggccggttgactgtttcttcgttggagggccatgttgactcgtactaataataaaaataataatactaggttgactttttcaattccaacgcagcagtgcaaagctgcccacctatgagcacaggtccttttttaactccgtttttgtacgtacacacgtactgtccagcctgtgtctaataatcttaccaaaaacctgtcatctcactatcaaccaatcaggctctccgcctgttcgtcgaggaacagcagttgttttccctactccaacatagagtacactatggacgcacattaccatgccagcttgagcttagcattgcccaccgttggataactgccatgccattctcaggccctgtttagttcccatctaaaaatttttcatccattccatcgaatctttggacacatgcatggaacattaaatgtagataaaaaaataaactaattacacagtttagttgagaatcgcgagacgaatcttttaagtctagttactccataattagccttaagtgctacagtaatccacatatactaatgacagattaattatgcttaataaatttgtcttacagtttcctgacgagctatgtaatttgtttttttattagtttctaaaaacccctcccgacatccttccgacatatccgatgtgacaaccaaaaaattttcatcttcaatctaaacaggccctcactctcatcatctcatgccggggcagcaggtccgtcgtcaggtctgtcgtcccgtcccgtgccgtctgaagcaacaggcgagagaaacgccgttccatcggtttgccgagcgtgcagaggatagagctatactcgatccggagaggattgtgaaacgaagcacggttaagcagtgccgcgcacgtgctgctctgctcctggatccgatccagatcgactcggggcgtctcggcctcagcggcgatggcaatcatcgcgcgcgctgctggagctggacgttttcgtcttgcattgcaggaggcggaacagaacggagaaagccacggcgcgctttgccgacgccacgcgctgacacgagggacccgttcagcggccagcacgcagcctaatcatgcctgtcggggggagctcatccgttcctgaatttgggtcatgctccagtatcaggtattcaggtactagtactcctgagccatgtgctgcgacaaaaaagcgaggctcctgtagtagagccttgtttacttacaaaattttttacattctcagttatattaaatcttgtgacacatgcataaagcattaaatatacataaaagaaataattatttacacagttacttataatttgcgaaacgaatcttttaagactggttagtttatgattagataatatttattaaatacaaatgaaagtaatattatttatattttgcaaaaagtaaataagacctaggtagctaggccaacgtgagcatgtcggacccggaccggttcgttctacggcgcgtcccgcaaacctgcagccaggtagtagtagtacaccgtgcacgggagaggtgcgccatgcatgctcgggcaaaagatcatagagaaaggtgcagcgtttcagttgcacacctgaccgagtgacgcctcgccttgtttggctttgttcccaaaattttttaaaattcctcatcacattaaatctttgaacgaatatatggagcattaaatataaataaaagaaataattaatcatacaatttgtctgtaatttgcgagacgaatcttttgagcctagttagtttataattaaataatatttgttaaatacaaacgaaaatgctacgttagccaaaactaaaatttttctccaaacgtgacccagcaccttccgatcaatcatcactcagcgggtcacgtcagaagatcagatggaccttgccgtccgggcctgtctctcggcctcctccccatctggaacgaacagaggtccagtcctgtttcgagtcgagctgagtcgatcagatgggcctaaataggccgaagacgtaggcaaagggcccgctgatttatctgattcttctaggaccgtgcatgcgcggatgggcctaggtggaaacccaacagatgtgaggcttcaaagaggaagaagtccgttacacatggagagttagtctataatgggataatatttaccacaaacaaataaaaatactacagtagcgaaatccaaaatttttcacatctaaacaaggccctagatgttttgtcagtgccagaccagagaaaatctcgtcttctgctgtcaatagctttgatgattcctggcggcagaggtaaagcttgcctgggccttgtttagttccgaaaagtgaaaagttttcggtactgtagcacttttgtttgttcgtgacaaatatcatccaattatggactaactagaattaaaagattcgtctcgtgatctacagctaaactgtgtaattagtttttgttttcgtctatatttaatgtttcatgcatgtgccacaagattcgatgtgacggagaattttgaaaattttttggttttcagagtgaactaaacaaggcccagatgtaattgaccatgccatcgagcgcgagttgactagagtgagtcggccctgatggttaagtagtgcagactgccaagtggacaaccgtctatcaactttgcagagtggggcgaatgcactgaggatgttggagaggggcaagccaaggtaaacttgaggaaagatgcttgttgacactgtagtatgtgaacaatcctgtttaattttgtgtcctcgacg

SEQ ID NO: 88 - DNA, 1790 bp, Setaria italica
tctcatggtgtcccaagcacagcaagagccagctctgcctcacagcagcagcaccgccaagcgcgcagccgcgtcactcatggacgcccgcccggcccagcctctcctcctccgcgccccgactcccagcattgacctccccgcgtccaagccggacagggccgccgcggcggccggcaaggccgccgccgcctccgtgttcgacctgcggcgggagcccaagatcccggcgccattcgtgtggccgcacgacgacgcgcggccggcgtcggcggcggagctggacgtgccgttggtggacgtgggcgtgctgcgcaatggcgaccgcgcggggctgcggcgcgctgcggcgcaggtggccgcggcgtgcgcgacgcacgggttcttccaggtgtgcgggcacggcgtgggcgcggacctggcgcgcgcggcgctggacggcgccagtgacttcttccggctgccgctggcggagaagcagcgcgcccggcgcgtcccggggaccgtgtccgggtacacgagcgcgcacgccgaccggttcgcgtccaagctcccctggaaggagaccctctccttcgggttccacgacggcgccgcgtcgcccgtcgtcgtcgactacttcgccggcaccctcgggcaggacttcgaggcagtggggcgggtgtaccagaggtactgcgaggagatgaaggctctgtcgctgacgatcatggagctcctggagctgagcctgggcgtggagcgcggctactaccgcgacttcttcgaggacagccgctccatcatgcggtgcaactactacccgccgtgcccggagccggagcgcacgctgggcacgggcccgcactgcgaccccaccgcgctgaccatcctcctccaggacgacgtcggcgggctcgaggtcctcgtcgacggcgactggcgccccgtccgccccgtccccggcgccatggtcatcaacatcggcgacaccttcatggctctgtccaacgggcggtacaagagctgcctgcaccgggcggtggtgaaccagcggcaggagcggcggtcgctggccttcttcctgtgcccgcgcgaggaccgggtggtgcgcccgccggccagcggcgccgtcggcgaggcgccccgccgctacccggacttcacctgggccgacctcatgcgcttcacgcagcgccactaccgcgccgacacccgcacgctggacgccttcacacgctggctctcccacggcccggcccaggacgcgccagtggcggcggcggcttccacctagctagcggcgcggatccgaccgagcccattgacgacgccgtccctttccgccgccgccggggcccgcgcgggggttcaccccacgtgcgcgcccaggtgggcgaggtggcggcctcgtggcccgcgggccccgcgccgccttcccatttttgggcgctgccgccccgcgcgcatgccggatgcgtgcgtccacggcctactgctgctactagtgtacatatacaaacatacatatatacgtagtataaatatataagcaagcggcccggtgccccttttcgttttcttgttttgtcgatcacaatctctggattcgatggatggataaatgtttgtacgcatgcatgtagatgggctcatgaaatttcagaatctggaacggacgaggagctcacgtgcctcttccgtgtctggtagcggtagctgcgtgccaaatgtctggtgggcccaaagaaattctagtgccacccgtccggatccggcatccgaaagttcccgacggttcgacacccgaa

SEQ ID NO: 89 - DNA, 1272 bp, Setaria italica
atggtgtcccaagcacagcaagagccagctctgcctcacagcagcagcaccgccaagcgcgcagccgcgtcactcatggacgcccgcccggcccagcctctcctcctccgcgccccgactcccagcattgacctccccgcgtccaagccggacagggccgccgcggcggccggcaaggccgccgccgcctccgtgttcgacctgcggcgggagcccaagatcccggcgccattcgtgtggccgcacgacgacgcgcggccggcgtcggcggcggagctggacgtgccgttggtggacgtgggcgtgctgcgcaatggcgaccgcgcggggctgcggcgcgctgcggcgcaggtggccgcggcgtgcgcgacgcacgggttcttccaggtgtgcgggcacggcgtgggcgcggacctggcgcgcgcggcgctggacggcgccagtgacttcttccggctgccgctggcggagaagcagcgcgcccggcgcgtcccggggaccgtgtccgggtacacgagcgcgcacgccgaccggttcgcgtccaagctcccctggaaggagaccctctccttcgggttccacgacggcgccgcgtcgcccgtcgtcgtcgactacttcgccggcaccctcgggcaggacttcgaggcagtggggcgggtgtaccagaggtactgcgaggagatgaaggctctgtcgctgacgatcatggagctcctggagctgagcctgggcgtggagcgcggctactaccgcgacttcttcgaggacagccgctccatcatgcggtgcaactactacccgccgtgcccggagccggagcgcacgctgggcacgggcccgcactgcgaccccaccgcgctgaccatcctcctccaggacgacgtcggcgggctcgaggtcctcgtcgacggcgactggcgccccgtccgccccgtccccggcgccatggtcatcaacatcggcgacaccttcatggctctgtccaacgggcggtacaagagctgcctgcaccgggcggtggtgaaccagcggcaggagcggcggtcgctggccttcttcctgtgcccgcgcgaggaccgggtggtgcgcccgccggccagcggcgccgtcggcgaggcgccccgccgctacccggacttcacctgggccgacctcatgcgcttcacgcagcgccactaccgcgccgacacccgcacgctggacgccttcacacgctggctctcccacggcccggcccaggacgcgccagtggcggcggcggcttccacctag

SEQ ID NO: 90 - protein, 423 aa, Setaria italica
MVSQAQQEPALPHSSSTAKRAAASLMDARPAQPLLLRAPTPSIDLPASKPDRAAAAAGKAAAASVFDLRREPKIPAPFVWPHDDARPASAAELDVPLVDVGVLRNGDRAGLRRAAAQVAAACATHGFFQVCGHGVGADLARAALDGASDFFRLPLAEKQRARRVPGTVSGYTSAHADRFASKLPWKETLSFGFHDGAASPVVVDYFAGTLGQDFEAVGRVYQRYCEEMKALSLTIMELLELSLGVERGYYRDFFEDSRSIMRCNYYPPCPEPERTLGTGPHCDPTALTILLQDDVGGLEVLVDGDWRPVRPVPGAMVINIGDTFMALSNGRYKSCLHRAVVNQRQERRSLAFFLCPREDRVVRPPASGAVGEAPRRYPDFTWADLMRFTQRHYRADTRTLDAFTRWLSHGPAQDAPVAAAAST

SEQ ID NO: 91 - DNA, 2888 bp, Setaria italica
tctcatggtgtcccaagcacagcaagagccagctctgcctcacagcagcagcaccgccaagcgcgcagccgcgtcactcatggacgcccgcccggcccagcctctcctcctccgcgccccgactcccagcattgacctccccgcgtccaagccggacagggccgccgcggcggccggcaaggccgccgccgcctccgtgttcgacctgcggcgggagcccaagatcccggcgccattcgtgtggccgcacgacgacgcgcggccggcgtcggcggcggagctggacgtgccgttggtggacgtgggcgtgctgcgcaatggcgaccgcgcggggctgcggcgcgctgcggcgcaggtggccgcggcgtgcgcgacgcacgggttcttccaggtgtgcgggcacggcgtgggcgcggacctggcgcgcgcggcgctggacggcgccagtgacttcttccggctgccgctggcggagaagcagcgcgcccggcgcgtcccggggaccgtgtccgggtacacgagcgcgcacgccgaccggttcgcgtccaagctcccctggaaggagaccctctccttcgggttccacgacggcgccgcgtcgcccgtcgtcgtcgactacttcgccggcaccctcgggcaggacttcgaggcagtggggtaagtatgtaggaatgaacttggcacgcattgcatccacatggcgtgctgatcgaacgagctgagccaaccggcatgcacacatggcgtggcaggcgggtgtaccagaggtactgcgaggagatgaaggctctgtcgctgacgatcatggagctcctggagctgagcctgggcgtggagcgcggctactaccgcgacttcttcgaggacagccgctccatcatgcggtgcaactactacccgccgtgcccggagccggagcgcacgctgggcacgggcccgcactgcgaccccaccgcgctgaccatcctcctccaggacgacgtcggcgggctcgaggtcctcgtcgacggcgactggcgccccgtccgccccgtccccggcgccatggtcatcaacatcggcgacaccttcatggtacggccgccgctaatccatccttttgttgctcttatctcctctggcgagtgcgagtaacgaaagcgctagctcccctgctccttgtcctgctctgtttcccaagtcctaatggagctaaccgggcagactgcaacacgcacgcgtaggcatgtcacgtagccaccacttgcactgtgctgcgcagcgacgacgcaacgcggacgtgcgttcgagtcggttccatctcggcgccgctacacgcggccgcggctcctagcctcctagggctccctgatccctatccccgagcccttccgcgggaaaagttcgttggcgacggcagaggagagccgacgggtccgtgccgttggagcgtggcggcaggagaggccgggagggtgttttgttgcgttgcgcggcggcgcggaggatgcgatggcgcgggcgggcggcgctttcggcggtggcccccgcgacccacgtgcgcgcgcggtctcgtcgccttccctgttttggtgccacctctctgtgtccgggaatgggttggcttagcggcgaccgagaccgggcggtggtctggcctgctcccggcgcccatcccgcctggtctctcatcctgctcctcctatgcgcgagggggcctgtagcggctggagtacaagcagattggttgggttgggttgctgctgcttggctgttgcccgcccgctttctagccgtttccgctcgccatccggcacgcggcgcccacgccggggctccagctcggcccctttggccgtgtgggtggcaggcacccctgcatcgtctcgtgcgtccggtttccgcgcctggccccccgccttgaggtttccctgtgcttttgacaagactttcgtagatatatgtgtgtgtatgtgtgtgtgtgcgtgcgcgcgtgtgtgtatatatatatataaataaataacatctgtgaatgatggattacacgtgtagctgaccggctgattgtgttcgcgtgtgtgtcttcgatgcattgcaggctctgtccaacgggcggtacaagagctgcctgcaccgggcggtggtgaaccagcggcaggagcggcggtcgctggccttcttcctgtgcccgcgcgaggaccgggtggtgcgcccgccggccagcggcgccgtcggcgaggcgccccgccgctacccggacttcacctgggccgacctcatgcgcttcacgcagcgccactaccgcgccgacacccgcacgctggacgccttcacacgctggctctcccacggcccggcccaggacgcgccagtggcggcggcggcttccacctagctagcggcgcggatccgaccgagcccattgacgacgccgtccctttccgccgccgccggggcccgcgcgggggttcaccccacgtgcgcgcccaggtgggcgaggtggcggcctcgtggcccgcgggccccgcgccgccttcccatttttgggcgctgccgccccgcgcgcatgccggatgcgtgcgtccacggcctactgctgctactagtgtacatatacaaacatacatatatacgtagtataaatatataagcaagcggcccggtgccccttttcgttttcttgttttgtcgatcacaatctctggattcgatggatggataaatgtttgtacgcatgcatgtagatgggctcatgaaatttcagaatctggaacggacgaggagctcacgtgcctcttccgtgtctggtagcggtagctgcgtgccaaatgtctggtgggcccaaagaaattctagtgccacccgtccggatccggcatccgaaagttcccgacggttcgacacccgaa

SEQ ID NO: 92 - DNA, 1567 bp, Oryza sativa
tgcccagacagctcgccctgcacacacacacacactcacactcacacacgctctcaactcactcccgctcaacacagcgctcacttctcatctccaatctcatggtggccgagcaccccacgccaccacagccgcaccaaccaccgcccatggactccaccgccggctctggcattgccgccccggcggcggcggcggtgtgcgacctgaggatggagcccaagatcccggagccattcgtgtggccgaacggcgacgcgaggccggcgtcggcggcggagctggacatgcccgtggtcgacgtgggcgtgctccgcgacggcgacgccgaggggctgcgccgcgccgcggcgcaggtggccgccgcgtgcgccacgcacgggttcttccaggtgtccgagcacggcgtcgacgccgctctggcgcgcgccgcgctcgacggcgccagcgacttcttccgcctcccgctcgccgagaagcgccgcgcgcgccgcgtcccgggcaccgtgtccggctacaccagcgcccacgccgaccgcttcgcctccaagctcccatggaaggagaccctctccttcggcttccacgaccgcgccgccgcccccgtcgtcgccgactacttctccagcaccctcggccccgacttcgcgccaatggggagggtgtaccagaagtactgcgaggagatgaaggagctgtcgctgacgatcatggaactcctggagctgagcctgggcgtggagcgaggctactacagggagttcttcgcggacagcagctcaatcatgcggtgcaactactacccgccatgcccggagccggagcggacgctcggcacgggcccgcactgcgaccccaccgccctcaccatcctcctccaggacgacgtcggcggcctcgaggtcctcgtcgacggcgaatggcgccccgtcagccccgtccccggcgccatggtcatcaacatcggcgacaccttcatggcgctgtcgaacgggaggtataagagctgcctgcacagggcggtggtgaaccagcggcgggagcggcggtcgctggcgttcttcctgtgcccgcgggaggacagggtggtgcggccgccgccgagcgccgccacgccgcagcactacccggacttcacctgggccgacctcatgcgcttcacgcagcgccactaccgcgccgacacccgcacgctcgacgccttcacgcgctggctcgcgccgccggccgccgacgccgccgcgacggcgcaggtcgaggcggccagctgatcgccgaacggaacgaaacggaacgaacagaagccgatttttggcggggcccacgcccacgtgaggccccacgtggacagtgggcccgggcggaggtggcacccacgtggaccgcgggccccgcgccgccttccaattttggaccctaccgctgtacatattcatatattgcaagaagaagcaaaacgtacgtgtgggttgggttgggcttctctctattactaaaaaaaatataatggaacgacggatgaatggatgcttatttatttatctaaattgaattcgaattcggctca

SEQ ID NO: 93 - DNA, 1170 bp, Oryza sativa
atggtggccgagcaccccacgccaccacagccgcaccaaccaccgcccatggactccaccgccggctctggcattgccgccccggcggcggcggcggtgtgcgacctgaggatggagcccaagatcccggagccattcgtgtggccgaacggcgacgcgaggccggcgtcggcggcggagctggacatgcccgtggtcgacgtgggcgtgctccgcgacggcgacgccgaggggctgcgccgcgccgcggcgcaggtggccgccgcgtgcgccacgcacgggttcttccaggtgtccgagcacggcgtcgacgccgctctggcgcgcgccgcgctcgacggcgccagcgacttcttccgcctcccgctcgccgagaagcgccgcgcgcgccgcgtcccgggcaccgtgtccggctacaccagcgcccacgccgaccgcttcgcctccaagctcccatggaaggagaccctctccttcggcttccacgaccgcgccgccgcccccgtcgtcgccgactacttctccagcaccctcggccccgacttcgcgccaatggggagggtgtaccagaagtactgcgaggagatgaaggagctgtcgctgacgatcatggaactcctggagctgagcctgggcgtggagcgaggctactacagggagttcttcgcggacagcagctcaatcatgcggtgcaactactacccgccatgcccggagccggagcggacgctcggcacgggcccgcactgcgaccccaccgccctcaccatcctcctccaggacgacgtcggcggcctcgaggtcctcgtcgacggcgaatggcgccccgtcagccccgtccccggcgccatggtcatcaacatcggcgacaccttcatggcgctgtcgaacgggaggtataagagctgcctgcacagggcggtggtgaaccagcggcgggagcggcggtcgctggcgttcttcctgtgcccgcgggaggacagggtggtgcggccgccgccgagcgccgccacgccgcagcactacccggacttcacctgggccgacctcatgcgcttcacgcagcgccactaccgcgccgacacccgcacgctcgacgccttcacgcgctggctcgcgccgccggccgccgacgccgccgcgacggcgcaggtcgaggcggccagctga

SEQ ID NO: 94 - protein, 389 aa, Oryza sativa
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSEHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 95 - DNA, 3140 bp, Oryza sativa
tgcccagacagctcgccctgcacacacacacacactcacactcacacacgctctcaactcactcccgctcaacacagcgctcacttctcatctccaatctcatggtggccgagcaccccacgccaccacagccgcaccaaccaccgcccatggactccaccgccggctctggcattgccgccccggcggcggcggcggtgtgcgacctgaggatggagcccaagatcccggagccattcgtgtggccgaacggcgacgcgaggccggcgtcggcggcggagctggacatgcccgtggtcgacgtgggcgtgctccgcgacggcgacgccgaggggctgcgccgcgccgcggcgcaggtggccgccgcgtgcgccacgcacgggttcttccaggtgtccgagcacggcgtcgacgccgctctggcgcgcgccgcgctcgacggcgccagcgacttcttccgcctcccgctcgccgagaagcgccgcgcgcgccgcgtcccgggcaccgtgtccggctacaccagcgcccacgccgaccgcttcgcctccaagctcccatggaaggagaccctctccttcggcttccacgaccgcgccgccgcccccgtcgtcgccgactacttctccagcaccctcggccccgacttcgcgccaatggggtaattaaaacgatggtggacgacattgcatttcaaattcaaaacaaattcaaaacacaccgaccgagattatgctgaattcaaacgcgtttgtgcgcgcaggagggtgtaccagaagtactgcgaggagatgaaggagctgtcgctgacgatcatggaactcctggagctgagcctgggcgtggagcgaggctactacagggagttcttcgcggacagcagctcaatcatgcggtgcaactactacccgccatgcccggagccggagcggacgctcggcacgggcccgcactgcgaccccaccgccctcaccatcctcctccaggacgacgtcggcggcctcgaggtcctcgtcgacggcgaatggcgccccgtcagccccgtccccggcgccatggtcatcaacatcggcgacaccttcatggtaaaccatctcctattctcctctcctctgttctcctctgcttcgaagcaacagaacaagtaattcaagcttttttttctctctcgcgcgaaattgacgagaaaaataagatcgtggtaggggcggggctttcagctgaaagcgggaagaaaccgacctgacgtgatttctctgttccaatcacaaacaatggaatgccccactcctccatgtgttatgatttatctcacatcttatagttaataggagtaagtaacaagctacttttttcatattatagttcgtttgattttttttttttaaagtttttttagttttatccaaatttattgaaaaacttagcaacgtttataataccaaattagtctcatttagtttaatattgtatatattttgataatatatttatgttatattaaaaatattactatatttttctataaacattattaaaagccatttataatataaaatggaaggagtaattaatatggatctcccccgacatgagaatattttccgatggtgtgacgacgccatgtaagcttcggtgggcctggacggccagaggtgccaacagccacgtccaacaacccctgggtccccccctaacactccaaacagtagtgagtagtgtctcgtcgcgttttagtatttgatgacaaacaaagtgtgagttgagttagccaccaccaacttgcacacgagcacatacatttgtgtccattctcgccagtcacttccatctctagtcctaactcctatctagcgatgtaagcggataatttcatcatccgtatataaacctgtttgttatagttaatttcctatataatactataacagtatacattttaaaagaaaacaaaattaggataaacaggccctgctcctatccatccatggcacttggaaggaccagactcggtcatgccatgccaagccaagatatgggttatggaagagtagagaagaggagagatgagagataagcatgcgttctcctcctcgttggatgtgtattttggagggatttgtgtagtagtagcagcggcgccgcggggacggatgcggatggtggcgctttcggtggcgttttcccgggggggttttggtttggcgcttgggggggatggcatggcgcggcgtgcggctgcacgccacacacacgcgcgcgcacgcacgtacgtcgtcgtcgccgcgggcggacggtagcttagggtggtgtgttccgcgcgcgggcgcggattgttccatgccgatcgatttggcgccaccctcgccgcggctcttgtcgcgtcgtgcgcctctctcgcgcggtttgtccttgtcgcgttgctcagccggcgacgggggcacggacattggcgatgtagccctgcacgtgtcggcctctccgttgatgaatgatgatgtatgtatgtatttttttttgtctgaaggaatttgtggggaattgttgtgtgtgcaggcgctgtcgaacgggaggtataagagctgcctgcacagggcggtggtgaaccagcggcgggagcggcggtcgctggcgttcttcctgtgcccgcgggaggacagggtggtgcggccgccgccgagcgccgccacgccgcagcactacccggacttcacctgggccgacctcatgcgcttcacgcagcgccactaccgcgccgacacccgcacgctcgacgccttcacgcgctggctcgcgccgccggccgccgacgccgccgcgacggcgcaggtcgaggcggccagctgatcgccgaacggaacgaaacggaacgaacagaagccgatttttggcggggcccacgcccacgtgaggccccacgtggacagtgggcccgggcggaggtggcacccacgtggaccgcgggccccgcgccgccttccaattttggaccctaccgctgtacatattcatatattgcaagaagaagcaaaacgtacgtgtgggttgggttgggcttctctctattactaaaaaaaatataatggaacgacggatgaatggatgcttatttatttatctaaattgaattcgaattcggctca

SEQ ID NO: 96 - DNA, 1170 bp, Triticum aestivum
atggacaccagccctgcaactcccctgctcctccagcctcctgctcccagcattgacccgttcgccgccaaggcggccgtcaacaagggcggcggcgcggcaaccgcggtgtacgacctccggagggagccgaagatccccgccccgttcgtgtggccgcacgccgaggtgcgccccaccacggcccaggagctggccgtgccggtggtggacgtgggcgtgctgcgcaatggcgacgccgcggggctccgccgcgccgtggcgcaggtggccgcggcgtgcgccacgcacgggttcttccaggtgtccgggcacggcgtggacgaggccctggcgcgcgcggcgctggacggcgcgagcggcttcttccggctgccgctggccgagaagcagcgcgcgcggcgcgtcccggggaccgtgtccgggtacacgagcgcgcacgccgaccggttcgcctccaagctcccctggaaggagaccctctccttcggcttccacgaccgcgccggcgccgcgcccgtcgtggtggactacttcaccagcaccctcgggccggactacgagccaatggggagggtgtaccaggagtactgcgggaagatgaaggagctgtcgctgaggatcatggagctgctggagctgagccagggcgtggagaagcgcgggtactaccgggagttcttcgcggacagcagctccatcatgcggtgcaactactacccgccgtgcccggagccggagcgcacgctgggcacgggcccgcactgcgaccccacggcgctcaccatcctactgcaggacgacgtgggcgggctggaggtcctcgtcgacggcgactggcgccccgtccgccccgtccccggcgccatggtcatcaacatcggcgacaccttcatggcgctgtcgaacgggcggtacaagagctgcctgcaccgcgcggtggtgaaccggcggcaggagcggcggtcgctggccttcttcctgtgcccgcgcgaggaccgcgtggtgcggccgccgccgggcctgaggagcccgcggcggtacccggacttcacctgggctgacctcatgcgcttcacgcagcgccactaccgcgccgacacgcgcaccctcgacgccttcacccagtggttctcctcctcctcctcctcggcccaggaggcggcctga

SEQ ID NO: 97 - protein, 389 aa, Triticum aestivum
MDTSPATPLLLQPPAPSIDPFAAKAAVNKGGGAATAVYDLRREPKIPAPFVWPHAEVRPTTAQELAVPVVDVGVLRNGDAAGLRRAVAQVAAACATHGFFQVSGHGVDEALARAALDGASGFFRLPLAEKQRARRVPGTVSGYTSAHADRFASKLPWKETLSFGFHDRAGAAPVVVDYFTSTLGPDYEPMGRVYQEYCGKMKELSLRIMELLELSQGVEKRGYYREFFADSSSIMRCNYYPPCPEPERTLGTGPHCDPTALTILLQDDVGGLEVLVDGDWRPVRPVPGAMVINIGDTFMALSNGRYKSCLHRAVVNRRQERRSLAFFLCPREDRVVRPPPGLRSPRRYPDFTWADLMRFTQRHYRADTRTLDAFTQWFSSSSSSAQEAA

SEQ ID NO: 98 - DNA, 3050 bp, Triticum aestivum
ctcatggtgctccagaccgctcagcaagaaccatccctgacgcgtccgcctcactgcagcgtcgccagcgcgcgctcgccggcggccatggacaccagccctgcaactcccctgctcctccagcctcctgctcccagcattgacccgttcgccgccaaggcggccgtcaacaagggcggcggcgcggcaaccgcggtgtacgacctccggagggagccgaagatccccgccccgttcgtgtggccgcacgccgaggtgcgccccaccacggcccaggagctggccgtgccggtggtggacgtgggcgtgctgcgcaatggcgacgccgcggggctccgccgcgccgtggcgcaggtggccgcggcgtgcgccacgcacgggttcttccaggtgtccgggcacggcgtggacgaggccctggcgcgcgcggcgctggacggcgcgagcggcttcttccggctgccgctggccgagaagcagcgcgcgcggcgcgtcccggggaccgtgtccgggtacacgagcgcgcacgccgaccggttcgcctccaagctcccctggaaggagaccctctccttcggcttccacgaccgcgccggcgccgcgcccgtcgtggtggactacttcaccagcaccctcgggccggactacgagccaatggggtaatatatccacccgcccacacccctatccggccagcacgaatccatccccgccactgcatttttttccttttgtttccgcgcgaccgtacgttcgatcggcgcccacgtacgtacgtgcgtacgcagtagcagtacttgaagccgccgtactacgtgctgagtagtgacaactgaacacgtgcaggagggtgtaccaggagtactgcgggaagatgaaggagctgtcgctgaggatcatggagctgctggagctgagccagggcgtggagaagcgcgggtactaccgggagttcttcgcggacagcagctccatcatgcggtgcaactactacccgccgtgcccggagccggagcgcacgctgggcacgggcccgcactgcgaccccacggcgctcaccatcctactgcaggacgacgtgggcgggctggaggtcctcgtcgacggcgactggcgccccgtccgccccgtccccggcgccatggtcatcaacatcggcgacaccttcatggtaattactcctctctcagcgttgctttcgctgattaattgcagaaacagtagtcaactacccatgctctgttccgctgtgctctgcttcccaacgagcgaaccggcccataaaaactgccttgctgtcttggaaccaagaggaaagggaccgtgggagcctaccgacacgacgtgattgcactctgcttcctaacaagcgagccgccggtagggctatcaccgtaagggctcctttgattcaaaggaatttcttaggatttctgaaggattgaaatccttaggattttttcctatgttggtacttcgattcataggattgaatcccataggatttttttcctatgaaatcttctgtactacatttcataggaaatctaacatccactccaacctttttttatatttcctttgtttttcatgtgccatcaaacactccttgttaatcctataggattcaagtgggcatgccactccaatcctatacttttcccattcctacgttttcaaaatcctacgaatcaaagaggccctaaagctgctgacatgacgtgattttttttttcttttctttctttctttctcagctccaatcaacgctggttattagatcattagagtggacaggttgaattaacatgcagtagttagtagttagcagccacaaacgggtcccgttctctgaagtctgaactgacataagtcctgatcatcgaccattctttgcttcctaggacgatgcctgttggaacttgcgtccaatgcccgttagggagtggtaattgtcatcacttttagactcgtcgattccactgatgaagacgtagcacatggatgagccaacgtatccgtttctagtggtctcgaaaagtagggtttcattcattctatctatctatccgtccgtccaaaagggctgcgatgcgagcacttgagtcggagccaatcagagcgcgagaaaagatagggggggtagcaagccatgtcggaggggcgtttgcttccggcaggtttggattcttgtggtaggcgggcggctctgtacagtagcggcggtgacggtgaggtggcggcgctttcggtggcgggccaacccaggtgcatgcacgcgcgctcgtcgttttcccgcctgaatctgccgctgcgcccatggcaagggggtgggtgctgccgccgggcgatggagtagatcacggtcgccgtcgggctcggccagttgatcacggttcgttcgtgcggtactaggttcccccacggcactgtgactgcatcgttccggccctcgccattggcgatcgggcaatctcctgttcatccgtcgctgttgattcctcggccacgatagaccatgcgcgtgccggtcgtcgccccgtcgcgctcgcttcacgtgctcgtcgcgtggctcccgtcccacacgaggccgccgctttctgacccagtggagcgcgtgatttacagtttatatatgtcgctgcatttttctttttgtgtgctgctcattttgcttggacggagaccgggaacgattagccacggatctaacgcgttgttgcttgttttcaatgcatgcatgcaggcgctgtcgaacgggcggtacaagagctgcctgcaccgcgcggtggtgaaccggcggcaggagcggcggtcgctggccttcttcctgtgcccgcgcgaggaccgcgtggtgcggccgccgccgggcctgaggagcccgcggcggtacccggacttcacctgggctgacctcatgcgcttcacgcagcgccactaccgcgccgacacgcgcaccctcgacgccttcacccagtggttctcctcctcctcctcctcggcccaggaggcggcctgattctgctctgccacgaaacgatcggtccaca

SEQ ID NO: 99 - DNA, 1486 bp, Hordeum vulgare
gaccagtagcatatagtttttcttgtgtttgccatggtggacgtgtcgaactttgtagaagccaatggcaatgcagcagtatcgattcctgccatggaagttgctgggagtcctcacgtcccgttcgttcctcgggacgcgaacgcgacagacagcaagaatgccaaggacgtcctcgacctctggcggcagcagaaacaaatcccggctcccttcatctggccccacgccgacgcgcggccgtcgtcgatcttggagctggacgtgcccgtggtcgacatcggcgcggccctgcacagcgccgccgggatggcccgcgccgcggcgcaggtggccgaggcatgcgcgagccacggcttcttccaggtgaccgggcacggcgtcgaccccgcgctggcccaagcagcgctcgacggcgcagcggacttcttccgcctgccgctcgccaccaagcagcgcgcccgccgatccccggggaccgtcaaagggtacgcctccgcccacgccgaccgcttcgccgccaagcttccctggaaggagactctctccttcatccacaaccacgtccacgaggacgtcggcgcccgcgcaagcagtcacgtcgtcgactacttcacctccgcccttggcgacgacttcatgcacctaggggaggtgtaccaggagtactgtgaggcgatggaggacgcgtcgctggcgataatggaggtgctgggggtgagcctggggctggggagagggtactacagggacttcttcgccgacggcagctccatcatgaggtgcaactactacccgcggtgcccggagccggaccggacgctggggacggggccgcactgcgacccgtcggcgctgaccatcctgctgcaggacggcgaggtggacgggctccaggtgctcgtcgacggcgcatggcgctccgtgcggcccaagcccggcgagctcgtcgtaaacatcggcgacaccttcatggcgctgtcgaacggccggtacaagagctgcctccaccgcgcggtggtgcaccgggagaaggagcgccggtcgctggcctacttcctcgccccgcgggaggaccgggtggttcgcccgccgccttcgccggcgccggcgccgcggctctacccggacttcacctgggcggagctcatgcgattcacgcagcgccactaccgcgccgacgcccgcacgctcgacgccttcgcgtgctggctcgacctgcccagctgccccaccacgccccaggcccaagggactgtctagtgtctgtgatgtatcatctgtctcagctgttgtatacgaccacttgtgtctgctagctctgcgcttgtgtttcttatgtgagctaactaactaaatagtgtgtatatttcttgccgcgccttatgcaagccctagtctagaacatgtaataattaacttaagcatatacgttgatctttggtgtatttttcatatttccttcataatgaataatctattatgc

SEQ ID NO: 100 - DNA, 1230 bp, Hordeum vulgare
atggtggacgtgtcgaactttgtagaagccaatggcaatgcagcagtatcgattcctgccatggaagttgctgggagtcctcacgtcccgttcgttcctcgggacgcgaacgcgacagacagcaagaatgccaaggacgtcctcgacctctggcggcagcagaaacaaatcccggctcccttcatctggccccacgccgacgcgcggccgtcgtcgatcttggagctggacgtgcccgtggtcgacatcggcgcggccctgcacagcgccgccgggatggcccgcgccgcggcgcaggtggccgaggcatgcgcgagccacggcttcttccaggtgaccgggcacggcgtcgaccccgcgctggcccaagcagcgctcgacggcgcagcggacttcttccgcctgccgctcgccaccaagcagcgcgcccgccgatccccggggaccgtcaaagggtacgcctccgcccacgccgaccgcttcgccgccaagcttccctggaaggagactctctccttcatccacaaccacgtccacgaggacgtcggcgcccgcgcaagcagtcacgtcgtcgactacttcacctccgcccttggcgacgacttcatgcacctaggggaggtgtaccaggagtactgtgaggcgatggaggacgcgtcgctggcgataatggaggtgctgggggtgagcctggggctggggagagggtactacagggacttcttcgccgacggcagctccatcatgaggtgcaactactacccgcggtgcccggagccggaccggacgctggggacggggccgcactgcgacccgtcggcgctgaccatcctgctgcaggacggcgaggtggacgggctccaggtgctcgtcgacggcgcatggcgctccgtgcggcccaagcccggcgagctcgtcgtaaacatcggcgacaccttcatggcgctgtcgaacggccggtacaagagctgcctccaccgcgcggtggtgcaccgggagaaggagcgccggtcgctggcctacttcctcgccccgcgggaggaccgggtggttcgcccgccgccttcgccggcgccggcgccgcggctctacccggacttcacctgggcggagctcatgcgattcacgcagcgccactaccgcgccgacgcccgcacgctcgacgccttcgcgtgctggctcgacctgcccagctgccccaccacgccccaggcccaagggactgtctag

SEQ ID NO: 101 - protein, 409 aa, Hordeum vulgare
MVDVSNFVEANGNAAVSIPAMEVAGSPHVPFVPRDANATDSKNAKDVLDLWRQQKQIPAPFIWPHADARPSSILELDVPVVDIGAALHSAAGMARAAAQVAEACASHGFFQVTGHGVDPALAQAALDGAADFFRLPLATKQRARRSPGTVKGYASAHADRFAAKLPWKETLSFIHNHVHEDVGARASSHVVDYFTSALGDDFMHLGEVYQEYCEAMEDASLAIMEVLGVSLGLGRGYYRDFFADGSSIMRCNYYPRCPEPDRTLGTGPHCDPSALTILLQDGEVDGLQVLVDGAWRSVRPKPGELVVNIGDTFMALSNGRYKSCLHRAVVHREKERRSLAYFLAPREDRVVRPPPSPAPAPRLYPDFTWAELMRFTQRHYRADARTLDAFACWLDLPSCPTTPQAQGTV

SEQ ID NO: 102 - DNA, 1423 bp, Sorghum bicolor
cctctcatcacaggccccagcctcactcttctcacagcaagacatcgcagcctcacaaccacacagcaacgtgatcgccatgggcgggctcaccatggagcaggccttcgtgcaggcccccgagcaccgccccaagcccaccgtcaccgaggccaccggcatcctggtcatcgacctctcgcctctcaccgccagcgacaccgacgcggccgcggtggacgcgctggccgccgaggtgggcgcggcgagccgggactggggcttcttcgtggtggttggccacggcgtgcccgcggagaccgtggcgcgcgcgacggcggcgcagcgcgcgttcttcgcgctgccggcggagcggaaggccgccgtgcggaggagcgaggcggagccgctcgggtactacgagtcggagcacaccaagaacgtcagggactggaaggaggtgttcgacctcgtcccgcgcgatccgccgccgccagcagccgtggccgacggcgagctcgtcttcaagaacaagtggccccaggatctgccgggcttcagagaggcgctggaggagtacgcggcagcgatggaggagctgtcgttcaagctgctggagctgatcgcccggagcttgaagctgaggcccgaccggctgcacggcttcttcaaggaccagacgacgttcatccggctgaaccactaccctccatgcccgagcccggacctggcgctgggagtggggcggcacaaggacgcgggggcgctgaccatcctgtaccaggacgaagtgggcgggctggacgtccggcggcgctcctccgacggcggcggcggcgagtgggtgcgggtgaggcccgtgccggagtcgttcgtcatcaacgtcggcgacctcgtccaggtgtggagcaacgacaggtacgagagcgcggagcaccgggtgtcggtgaactcggcgagggagaggttctccatgccctacttcttcaacccggcgagctacaccatggtggagccggtggaggagctggtgagcgacgacgacccgcccaggtacgacgcctacagctggggcgagttcttcagcaccaggaagaacagcaacttcaagaagctcagcgtggagaacattcagatcgcgcatttcaagaagaccctcgtcctcgcctagataagcagcaggatactacaggtctacaggactaggacaagccgatcgaggtgaccggccgtcgtcttcagattcagtatatgcgtgtcgccgttcgtgttagaacaaattaataatgtgcgcgctgtgtgctgtgtgtgtggagtaaaaaaaaactaaacatggatgtgcatgttcaaaaaaaaaaacatggatgcgagtatgtttgggaataataacaggcttgtgacggtctggtttatttgcaaattcaaaccgaattggttgatcttc

SEQ ID NO: 103 - DNA, 1071 bp, Sorghum bicolor
atgggcgggctcaccatggagcaggccttcgtgcaggcccccgagcaccgccccaagcccaccgtcaccgaggccaccggcatcctggtcatcgacctctcgcctctcaccgccagcgacaccgacgcggccgcggtggacgcgctggccgccgaggtgggcgcggcgagccgggactggggcttcttcgtggtggttggccacggcgtgcccgcggagaccgtggcgcgcgcgacggcggcgcagcgcgcgttcttcgcgctgccggcggagcggaaggccgccgtgcggaggagcgaggcggagccgctcgggtactacgagtcggagcacaccaagaacgtcagggactggaaggaggtgttcgacctcgtcccgcgcgatccgccgccgccagcagccgtggccgacggcgagctcgtcttcaagaacaagtggccccaggatctgccgggcttcagagaggcgctggaggagtacgcggcagcgatggaggagctgtcgttcaagctgctggagctgatcgcccggagcttgaagctgaggcccgaccggctgcacggcttcttcaaggaccagacgacgttcatccggctgaaccactaccctccatgcccgagcccggacctggcgctgggagtggggcggcacaaggacgcgggggcgctgaccatcctgtaccaggacgaagtgggcgggctggacgtccggcggcgctcctccgacggcggcggcggcgagtgggtgcgggtgaggcccgtgccggagtcgttcgtcatcaacgtcggcgacctcgtccaggtgtggagcaacgacaggtacgagagcgcggagcaccgggtgtcggtgaactcggcgagggagaggttctccatgccctacttcttcaacccggcgagctacaccatggtggagccggtggaggagctggtgagcgacgacgacccgcccaggtacgacgcctacagctggggcgagttcttcagcaccaggaagaacagcaacttcaagaagctcagcgtggagaacattcagatcgcgcatttcaagaagaccctcgtcctcgcctag

SEQ ID NO: 104 - protein, 356 aa, Sorghum bicolor
MGGLTMEQAFVQAPEHRPKPTVTEATGILVIDLSPLTASDTDAAAVDALAAEVGAASRDWGFFVVVGHGVPAETVARATAAQRAFFALPAERKAAVRRSEAEPLGYYESEHTKNVRDWKEVFDLVPRDPPPPAAVADGELVFKNKWPQDLPGFREALEEYAAAMEELSFKLLELIARSLKLRPDRLHGFFKDQTTFIRLNHYPPCPSPDLALGVGRHKDAGALTILYQDEVGGLDVRRRSSDGGGGEWVRVRPVPESFVINVGDLVQVWSNDRYESAEHRVSVNSARERFSMPYFFNPASYTMVEPVEELVSDDDPPRYDAYSWGEFFSTRKNSNFKKLSVENIQIAHFKKTLVLA

SEQ ID NO: 105 - DNA, 1499 bp, Sorghum bicolor
cctctcatcacaggccccagcctcactcttctcacagcaagacatcgcagcctcacaaccacacagcaacgtgatcgccatgggcgggctcaccatggagcaggccttcgtgcaggcccccgagcaccgccccaagcccaccgtcaccgaggccaccggcatcctggtcatcgacctctcgcctctcaccgccagcgacaccgacgcggccgcggtggacgcgctggccgccgaggtgggcgcggcgagccgggactggggcttcttcgtggtggttggccacggcgtgcccgcggagaccgtggcgcgcgcgacggcggcgcagcgcgcgttcttcgcgctgccggcggagcggaaggccgccgtgcggaggagcgaggcggagccgctcgggtactacgagtcggagcacaccaagaacgtcagggactggaaggaggtgttcgacctcgtcccgcgcgatccgccgccgccagcagccgtggccgacggcgagctcgtcttcaagaacaagtggccccaggatctgccgggcttcaggtgacgaaatcaacttatcttttcgatcatattttaccatttaatagtttaacaataattgaacttttttttgcagagaggcgctggaggagtacgcggcagcgatggaggagctgtcgttcaagctgctggagctgatcgcccggagcttgaagctgaggcccgaccggctgcacggcttcttcaaggaccagacgacgttcatccggctgaaccactaccctccatgcccgagcccggacctggcgctgggagtggggcggcacaaggacgcgggggcgctgaccatcctgtaccaggacgaagtgggcgggctggacgtccggcggcgctcctccgacggcggcggcggcgagtgggtgcgggtgaggcccgtgccggagtcgttcgtcatcaacgtcggcgacctcgtccaggtgtggagcaacgacaggtacgagagcgcggagcaccgggtgtcggtgaactcggcgagggagaggttctccatgccctacttcttcaacccggcgagctacaccatggtggagccggtggaggagctggtgagcgacgacgacccgcccaggtacgacgcctacagctggggcgagttcttcagcaccaggaagaacagcaacttcaagaagctcagcgtggagaacattcagatcgcgcatttcaagaagaccctcgtcctcgcctagataagcagcaggatactacaggtctacaggactaggacaagccgatcgaggtgaccggccgtcgtcttcagattcagtatatgcgtgtcgccgttcgtgttagaacaaattaataatgtgcgcgctgtgtgctgtgtgtgtggagtaaaaaaaaactaaacatggatgtgcatgttcaaaaaaaaaaacatggatgcgagtatgtttgggaataataacaggcttgtgacggtctggtttatttgcaaattcaaaccgaattggttgatcttc

SEQ ID NO: 106 - DNA, 1490 bp, Setaria italica
accccacacacacacccgcactgcatgcggcgtcctagctaatcagtcgctgctggcagcctcacaagtcacacaactccgacgcaggaaagctcgatccatcgccatgggcggcttctccatggatcagtccttcgtgcaggcccccgagcaccgccccaagcccaccgtcaccgaggccacgggcatcccgctcatcgacctctcgccactcaccggcggtggcggcggcgacgcggccgccgtggacgcgctggccgccgaggtgggcgcggcgagccgggactggggcttcttcgtggtggtggggcacggtgtgccggcggagaccgtggcgcgcgccacggaggcgcagcgcgcgttcttcgccctgccggcggagcggaaagccgccgtgcggaggagcgaggcggagccgctcgggtactacgagtcggagcacaccaagaacgtcagggactggaaggaggtgtacgacctcgtcccgggcgggcttcagccgccgatagccgtggccgacggcgaggtcgtgttcgaaaacaagtggcccgaagacctgccgggattcagagaggcgttggaggagtacatgcaagcgatggaagagctggcattcaagatactggagctgatcgcccggagcctgaacctgaggcctgacagactgcacggcttcttcaaggaccagaccaccttcatccggctcaaccactaccctccctgcccgagccccgacctcgccctcggcgtcggccggcacaaggacgccggagcactgaccatcctctaccaggacgacgtcggcgggctcgacgtccggcgccgttccgacggcgattgggtccgcgtcaagcctgtccccgactccttcatcatcaacgtcggcgacctcatccaggtttggagcaacgacaggtacgagagcgcggagcaccgggttacggtgaactcggccaaggagaggttctccaggccctacttcttcaacccggcgggctacaccatggtggagccggtggaggagctggtgagcgaggaggacccgccccggtacgacgcctacaactggggcaacttcttcagcaccaggaagaacagcaacttcaagaagctgagcgtggagaacatccagatcgcgcatttcaagaggagcgtcgccgcctaggatacgcacagaaagatcccatatgctgacttgctgatgaggcgacaggcggccgtgtcgtcttcagattcagagactgggagtaaacatttgtgcggtgttctgtaatcgtgatgtgacgagaactttagatatatgtttggaaataacagccttgtgttggtctggcttatccgcaaagtcaagattttcttctacattttgggattattgttggtaagcattaagcaacgtccagttcttacttcttagctcgatcagtggacgtaggaccggcctctgatgacaagggtgatttatgagaaatgtcatgtatatatgttcc

SEQ ID NO: 107 - DNA, 1059 bp, Setaria italica
atgggcggcttctccatggatcagtccttcgtgcaggcccccgagcaccgccccaagcccaccgtcaccgaggccacgggcatcccgctcatcgacctctcgccactcaccggcggtggcggcggcgacgcggccgccgtggacgcgctggccgccgaggtgggcgcggcgagccgggactggggcttcttcgtggtggtggggcacggtgtgccggcggagaccgtggcgcgcgccacggaggcgcagcgcgcgttcttcgccctgccggcggagcggaaagccgccgtgcggaggagcgaggcggagccgctcgggtactacgagtcggagcacaccaagaacgtcagggactggaaggaggtgtacgacctcgtcccgggcgggcttcagccgccgatagccgtggccgacggcgaggtcgtgttcgaaaacaagtggcccgaagacctgccgggattcagagaggcgttggaggagtacatgcaagcgatggaagagctggcattcaagatactggagctgatcgcccggagcctgaacctgaggcctgacagactgcacggcttcttcaaggaccagaccaccttcatccggctcaaccactaccctccctgcccgagccccgacctcgccctcggcgtcggccggcacaaggacgccggagcactgaccatcctctaccaggacgacgtcggcgggctcgacgtccggcgccgttccgacggcgattgggtccgcgtcaagcctgtccccgactccttcatcatcaacgtcggcgacctcatccaggtttggagcaacgacaggtacgagagcgcggagcaccgggttacggtgaactcggccaaggagaggttctccaggccctacttcttcaacccggcgggctacaccatggtggagccggtggaggagctggtgagcgaggaggacccgccccggtacgacgcctacaactggggcaacttcttcagcaccaggaagaacagcaacttcaagaagctgagcgtggagaacatccagatcgcgcatttcaagaggagcgtcgccgcctag

SEQ ID NO: 108 - protein, 352 aa, Setaria italica
MGGFSMDQSFVQAPEHRPKPTVTEATGIPLIDLSPLTGGGGGDAAAVDALAAEVGAASRDWGFFVVVGHGVPAETVARATEAQRAFFALPAERKAAVRRSEAEPLGYYESEHTKNVRDWKEVYDLVPGGLQPPIAVADGEVVFENKWPEDLPGFREALEEYMQAMEELAFKILELIARSLNLRPDRLHGFFKDQTTFIRLNHYPPCPSPDLALGVGRHKDAGALTILYQDDVGGLDVRRRSDGDWVRVKPVPDSFIINVGDLIQVWSNDRYESAEHRVTVNSAKERFSRPYFFNPAGYTMVEPVEELVSEEDPPRYDAYNWGNFFSTRKNSNFKKLSVENIQIAHFKRSVAA

SEQ ID NO: 109 - DNA, 1886 bp, Setaria italica
accccacacacacacccgcactgcatgcggcgtcctagctaatcagtcgctgctggcagcctcacaagtcacacaactccgacgcaggaaagctcgatccatcgccatgggcggcttctccatggatcagtccttcgtgcaggcccccgagcaccgccccaagcccaccgtcaccgaggccacgggcatcccgctcatcgacctctcgccactcaccggcggtggcggcggcgacgcggccgccgtggacgcgctggccgccgaggtgggcgcggcgagccgggactggggcttcttcgtggtggtggggcacggtgtgccggcggagaccgtggcgcgcgccacggaggcgcagcgcgcgttcttcgccctgccggcggagcggaaagccgccgtgcggaggagcgaggcggagccgctcgggtactacgagtcggagcacaccaagaacgtcagggactggaaggaggtgtacgacctcgtcccgggcgggcttcagccgccgatagccgtggccgacggcgaggtcgtgttcgaaaacaagtggcccgaagacctgccgggattcaggtgaatcaacttgcgcatattgttgtttctggcattgcatatgatcgtcgtgccagtatgttttgacaatatttttgttttcatatttttggtgaagatgggaaaatctttgttgaaataatcagggaattttcacatctttttttaatcaaagatagaataggttcggttactgaattttgatgatggacagaaaaagctgtgttttcactttccatctcagcgatgtttttttgtggatgaattctcctaaatttttgtcttttcatgttaaaacttgaacgggaattctcgcagagaggcgttggaggagtacatgcaagcgatggaagagctggcattcaagatactggagctgatcgcccggagcctgaacctgaggcctgacagactgcacggcttcttcaaggaccagaccaccttcatccggctcaaccactaccctccctgcccgagccccgacctcgccctcggcgtcggccggcacaaggacgccggagcactgaccatcctctaccaggacgacgtcggcgggctcgacgtccggcgccgttccgacggcgattgggtccgcgtcaagcctgtccccgactccttcatcatcaacgtcggcgacctcatccaggtacaacaaacaaaaacacacgtcattctcaaatcttttcgtgctgttaatgctcattcacgaattgatatcttacatgaacgactgagactttttcaggtttggagcaacgacaggtacgagagcgcggagcaccgggttacggtgaactcggccaaggagaggttctccaggccctacttcttcaacccggcgggctacaccatggtggagccggtggaggagctggtgagcgaggaggacccgccccggtacgacgcctacaactggggcaacttcttcagcaccaggaagaacagcaacttcaagaagctgagcgtggagaacatccagatcgcgcatttcaagaggagcgtcgccgcctaggatacgcacagaaagatcccatatgctgacttgctgatgaggcgacaggcggccgtgtcgtcttcagattcagagactgggagtaaacatttgtgcggtgttctgtaatcgtgatgtgacgagaactttagatatatgtttggaaataacagccttgtgttggtctggcttatccgcaaagtcaagattttcttctacattttgggattattgttggtaagcattaagcaacgtccagttcttacttcttagctcgatcagtggacgtaggaccggcctctgatgacaagggtgatttatgagaaatgtcatgtatatatgttcc

SEQ ID NO: 110 - DNA, 1379 bp, Oryza sativa
aagccacacgcacacacacacacacgctgacacacgagacgaacacttgtgctacagcttctcgccaccagctactgatcgaccatgggcggcctctccatggaccaggcgttcgtgcaggcccccgagcaccgccccaaggcgtccgtcgccgaggccgacggcatcccggtcatcgacctctcccctctcctcgccgccggcgatggcgacgccgacggggtggacgcgctcgcggcggaggtcgggagggcgagccgggactggggcttcttcgtggtggtgcgccacggtgtgcccgcggaggcggtggcgcgcgcggcggaggcgcagaggacgttcttcgcgctgccgccggagcggagggcggccgtggcgcggagcgaggcggcgccgatggggtactacgcgtccgagcacaccaagaacgtcagggactggaaggaggtgttcgacctcgtcccgcgccagacgccgccgccgccgacgaccgccgtggccgacggcgacctggtgttcgacaacaagtggcccgacgacctgccgggattcagggaggcaatggaggagtacggcgaagcggtggaggagctggcgttcaagctgctggagctgatcgccaggagcctcggcctgagacccgaccgcctccatggcttcttcaaggacgaccagaccaccttcatccggctcaaccactaccctccctgcccgagccccgacctcgccctcggcgtcggccgccacaaggacgccggcgcgctcaccgtgctctaccaggacgatgtcggcggcctcgacgtccgccgccgatccgacggcgagtgggtgcgcgtcaggcccgtccctcactccttcatcatcaacgtcggcgacatcatccaggtgtggagcaatgacaggtacgagagcgcggagcaccgggtggcggtgaacgtggagaaggagaggttctccatccctttcttcttcaacccggcgggccacaccatggtggagccactggaggaggtcgtgagcgacgagagcccggccaggtacaacccctacaactggggcgaattcttcagcaccaggaagaacagcaacttcaagaagctggacgtggagaacgtccagatcacgcatttcaggaagaattaacgcgccggctagatcatgttcagtaaattttcagatgatgatgcgtggacaaccatatagcctttgcgtcataagttaataatgtctgtgacagtatatcatgtaaacaatcgtatgatgtggcttctctatctgccggtgatggtaatgtgacattgtagaagagggtttgtgagatacttccttcacttaacttttacgaatgaatatagacaaccacaacatccttgtcgtga

SEQ ID NO: 111 - DNA, 1059 bp, Oryza sativa
atgggcggcctctccatggaccaggcgttcgtgcaggcccccgagcaccgccccaaggcgtccgtcgccgaggccgacggcatcccggtcatcgacctctcccctctcctcgccgccggcgatggcgacgccgacggggtggacgcgctcgcggcggaggtcgggagggcgagccgggactggggcttcttcgtggtggtgcgccacggtgtgcccgcggaggcggtggcgcgcgcggcggaggcgcagaggacgttcttcgcgctgccgccggagcggagggcggccgtggcgcggagcgaggcggcgccgatggggtactacgcgtccgagcacaccaagaacgtcagggactggaaggaggtgttcgacctcgtcccgcgccagacgccgccgccgccgacgaccgccgtggccgacggcgacctggtgttcgacaacaagtggcccgacgacctgccgggattcagggaggcaatggaggagtacggcgaagcggtggaggagctggcgttcaagctgctggagctgatcgccaggagcctcggcctgagacccgaccgcctccatggcttcttcaaggacgaccagaccaccttcatccggctcaaccactaccctccctgcccgagccccgacctcgccctcggcgtcggccgccacaaggacgccggcgcgctcaccgtgctctaccaggacgatgtcggcggcctcgacgtccgccgccgatccgacggcgagtgggtgcgcgtcaggcccgtccctcactccttcatcatcaacgtcggcgacatcatccaggtgtggagcaatgacaggtacgagagcgcggagcaccgggtggcggtgaacgtggagaaggagaggttctccatccctttcttcttcaacccggcgggccacaccatggtggagccactggaggaggtcgtgagcgacgagagcccggccaggtacaacccctacaactggggcgaattcttcagcaccaggaagaacagcaacttcaagaagctggacgtggagaacgtccagatcacgcatttcaggaagaattaa

SEQ ID NO: 112 - protein, 352 aa, Oryza sativa
MGGLSMDQAFVQAPEHRPKASVAEADGIPVIDLSPLLAAGDGDADGVDALAAEVGRASRDWGFFVVVRHGVPAEAVARAAEAQRTFFALPPERRAAVARSEAAPMGYYASEHTKNVRDWKEVFDLVPRQTPPPPTTAVADGDLVFDNKWPDDLPGFREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 113 - DNA, 2027 bp, Oryza sativa
aagccacacgcacacacacacacacgctgacacacgagacgaacacttgtgctacagcttctcgccaccagctactgatcgaccatgggcggcctctccatggaccaggcgttcgtgcaggcccccgagcaccgccccaaggcgtccgtcgccgaggccgacggcatcccggtcatcgacctctcccctctcctcgccgccggcgatggcgacgccgacggggtggacgcgctcgcggcggaggtcgggagggcgagccgggactggggcttcttcgtggtggtgcgccacggtgtgcccgcggaggcggtggcgcgcgcggcggaggcgcagaggacgttcttcgcgctgccgccggagcggagggcggccgtggcgcggagcgaggcggcgccgatggggtactacgcgtccgagcacaccaagaacgtcagggactggaaggaggtgttcgacctcgtcccgcgccagacgccgccgccgccgacgaccgccgtggccgacggcgacctggtgttcgacaacaagtggcccgacgacctgccgggattcaggtcaggtcaccacatcgatcgatcgtcttcttcatcctcgcatcaattcagttcaacctcatcgaattcttgagcagggaggcaatggaggagtacggcgaagcggtggaggagctggcgttcaagctgctggagctgatcgccaggagcctcggcctgagacccgaccgcctccatggcttcttcaaggacgaccagaccaccttcatccggctcaaccactaccctccctgcccgagccccgacctcgccctcggcgtcggccgccacaaggacgccggcgcgctcaccgtgctctaccaggacgatgtcggcggcctcgacgtccgccgccgatccgacggcgagtgggtgcgcgtcaggcccgtccctcactccttcatcatcaacgtcggcgacatcatccaggtacttttttttttgagcagctacatatttatcaacaaattttcttctaacaatttatcggacataaatatattacaatgaaagaataattgtatcataacttgtgtgtccttatatgtaagttttagaaatcctatagtaacatggtattttcgcgaaagcggagattgtgagaccgtatcttttcacccatgcgcgtcatatgatttttttttcttgccaacttaaataaatttcaaagtaaatctaatagattaaaattatgtgaaacttacatataagttttctacggtaacacgctattttcacgaaacggaggtcgttccaagttgaatgaatcttgaagtaaatctaacgatttaaaattatgtgcatacacgttatattacagttatatacaagttataatataattacactacaattataacggtattcatagttgacaaacttttaaaagagaattagttaataaatatataacaacattgtagtttaattgttactatttgacatcatttttatttgcattttgaatttgactgaaaaaattgagagtgcgcttgtccaggtgtggagcaatgacaggtacgagagcgcggagcaccgggtggcggtgaacgtggagaaggagaggttctccatccctttcttcttcaacccggcgggccacaccatggtggagccactggaggaggtcgtgagcgacgagagcccggccaggtacaacccctacaactggggcgaattcttcagcaccaggaagaacagcaacttcaagaagctggacgtggagaacgtccagatcacgcatttcaggaagaattaacgcgccggctagatcatgttcagtaaattttcagatgatgatgcgtggacaaccatatagcctttgcgtcataagttaataatgtctgtgacagtatatcatgtaaacaatcgtatgatgtggcttctctatctgccggtgatggtaatgtgacattgtagaagagggtttgtgagatacttccttcacttaacttttacgaatgaatatagacaaccacaacatccttgtcgtga

SEQ ID NO: 114 - DNA, 1747 bp, Triticum aestivum
tcactcaaggccacaacacactcgccagtccatcgccaccatacgtgacaacttgagttacttgatctgttgctcatcgatctcgacatcgccatgggcggcctctccatggaccaggccttcgtgcaggcccccgagcatcgcaccaaggcgaacctcgccgacgcggccggcatcccggtcatcgacctctcccctctcgccgccggcgacaaggccggcctggacgccctcgcggccgaggtgggcagggcgagccgtgactgggggttcttcgtggtggtgcgccacggcgtgccggcggagacggtggcgcgggcgctggaggcgcagagggccttcttcgcgctgcccgcggaccggaaggcggccgtgcggagggacgaggcggcgccgctggggtactacgagtcggagcacaccaagaacgtcagggactggaaggaggtgttcgacctcgtcccccgcgagccgccgccgcctgccgcggttgccgacggcgagctcatgttcgagaacaagtggcccgaggacctgccggggttcagagaggctctcgaagagtacgagaaagcgatggaggagctggcgttcaagctgctggagctgatcgcccggagcctgggactgagaccggaccggctgcacggcttcttcaaggaccagaccaccttcatccggctgaaccactacccgccctgccccagccccgacctcgccctcggcgtcggtcgccacaaggacgccggcgcgctcaccatcctctaccaggacgacgtcggcgggctcgacgtccggcgccgctccgacggcgagtgggtgcgcgtcaggcctgtcccggactcctacgtcatcaacgtcggcgacatcatccaggtgtggagcaacgacaggtacgagagcgcggagcacagggtgtcggtgaactcgcacaaggagaggttctccatgccctacttcttcgaccccgggagcgacgccatgatcgagccgttggaggagatggtgagcgacgaaaggccggccaggtacgacgcctacaactggggcaacttcttcagcaccaggaagaacagcaacttcaggaagctcgccgtcgaaaacgtccagatcgcacacttcagaaaggaccgaccttaaatgaaggatccctcatgaattcatgatccttccgctctcctcagtgatcctagtgctacaactacaagcatctccccgtttgtagtaatcatatataaataagtattccctccgtaaactaatataagagcatttaaaacactactctagtgatctaaatgctcttatattagtttacagagagagtattgtgtattaataatgactttctctgtttcaaaataagtgatgacgtggttttagttcaattttttttagagaggaggcatctgacgggccttaaactgaggaccttagagtacaaacaaggttcgacgaaagtaagtttaagggatacaaggccgtagccaacaaaacgcgacgcagcgcgcaatctaaaatcagcgtgctgtcaaggtagctggagacgtccatgccgttaatctctctcaagaagctcgccgaagctcagtgcaccttgcgtgcactcttgtgaagagcaccttcacgtgtcctttgtcctgagattttgtcaacagtttccatgactgcaagaaaaacactagtttgtataatagctcagcgggatgtcgaatgaattgcccctcaatcaaagctttatttctag

SEQ ID NO: 115 - DNA, 1047 bp, Triticum aestivum
atgggcggcctctccatggaccaggccttcgtgcaggcccccgagcatcgcaccaaggcgaacctcgccgacgcggccggcatcccggtcatcgacctctcccctctcgccgccggcgacaaggccggcctggacgccctcgcggccgaggtgggcagggcgagccgtgactgggggttcttcgtggtggtgcgccacggcgtgccggcggagacggtggcgcgggcgctggaggcgcagagggccttcttcgcgctgcccgcggaccggaaggcggccgtgcggagggacgaggcggcgccgctggggtactacgagtcggagcacaccaagaacgtcagggactggaaggaggtgttcgacctcgtcccccgcgagccgccgccgcctgccgcggttgccgacggcgagctcatgttcgagaacaagtggcccgaggacctgccggggttcagagaggctctcgaagagtacgagaaagcgatggaggagctggcgttcaagctgctggagctgatcgcccggagcctgggactgagaccggaccggctgcacggcttcttcaaggaccagaccaccttcatccggctgaaccactacccgccctgccccagccccgacctcgccctcggcgtcggtcgccacaaggacgccggcgcgctcaccatcctctaccaggacgacgtcggcgggctcgacgtccggcgccgctccgacggcgagtgggtgcgcgtcaggcctgtcccggactcctacgtcatcaacgtcggcgacatcatccaggtgtggagcaacgacaggtacgagagcgcggagcacagggtgtcggtgaactcgcacaaggagaggttctccatgccctacttcttcgaccccgggagcgacgccatgatcgagccgttggaggagatggtgagcgacgaaaggccggccaggtacgacgcctacaactggggcaacttcttcagcaccaggaagaacagcaacttcaggaagctcgccgtcgaaaacgtccagatcgcacacttcagaaaggaccgaccttaa

SEQ ID NO: 116 - protein, 348 aa, Triticum aestivum
MGGLSMDQAFVQAPEHRTKANLADAAGIPVIDLSPLAAGDKAGLDALAAEVGRASRDWGFFVVVRHGVPAETVARALEAQRAFFALPADRKAAVRRDEAAPLGYYESEHTKNVRDWKEVFDLVPREPPPPAAVADGELMFENKWPEDLPGFREALEEYEKAMEELAFKLLELIARSLGLRPDRLHGFFKDQTTFIRLNHYPPCPSPDLALGVGRHKDAGALTILYQDDVGGLDVRRRSDGEWVRVRPVPDSYVINVGDIIQVWSNDRYESAEHRVSVNSHKERFSMPYFFDPGSDAMIEPLEEMVSDERPARYDAYNWGNFFSTRKNSNFRKLAVENVQIAHFRKDRP

SEQ ID NO: 117 - DNA, 1863 bp, Triticum aestivum
tcactcaaggccacaacacactcgccagtccatcgccaccatacgtgacaacttgagttacttgatctgttgctcatcgatctcgacatcgccatgggcggcctctccatggaccaggccttcgtgcaggcccccgagcatcgcaccaaggcgaacctcgccgacgcggccggcatcccggtcatcgacctctcccctctcgccgccggcgacaaggccggcctggacgccctcgcggccgaggtgggcagggcgagccgtgactgggggttcttcgtggtggtgcgccacggcgtgccggcggagacggtggcgcgggcgctggaggcgcagagggccttcttcgcgctgcccgcggaccggaaggcggccgtgcggagggacgaggcggcgccgctggggtactacgagtcggagcacaccaagaacgtcagggactggaaggaggtgttcgacctcgtcccccgcgagccgccgccgcctgccgcggttgccgacggcgagctcatgttcgagaacaagtggcccgaggacctgccggggttcaggtacggtcatcaactcaatcaattctgcgaccccgagagaaatggttcactattattcgtggttcatacgtatgattcagacgttaatctcgatgcaaattgatttgtgcatgcagagaggctctcgaagagtacgagaaagcgatggaggagctggcgttcaagctgctggagctgatcgcccggagcctgggactgagaccggaccggctgcacggcttcttcaaggaccagaccaccttcatccggctgaaccactacccgccctgccccagccccgacctcgccctcggcgtcggtcgccacaaggacgccggcgcgctcaccatcctctaccaggacgacgtcggcgggctcgacgtccggcgccgctccgacggcgagtgggtgcgcgtcaggcctgtcccggactcctacgtcatcaacgtcggcgacatcatccaggtgtggagcaacgacaggtacgagagcgcggagcacagggtgtcggtgaactcgcacaaggagaggttctccatgccctacttcttcgaccccgggagcgacgccatgatcgagccgttggaggagatggtgagcgacgaaaggccggccaggtacgacgcctacaactggggcaacttcttcagcaccaggaagaacagcaacttcaggaagctcgccgtcgaaaacgtccagatcgcacacttcagaaaggaccgaccttaaatgaaggatccctcatgaattcatgatccttccgctctcctcagtgatcctagtgctacaactacaagcatctccccgtttgtagtaatcatatataaataagtattccctccgtaaactaatataagagcatttaaaacactactctagtgatctaaatgctcttatattagtttacagagagagtattgtgtattaataatgactttctctgtttcaaaataagtgatgacgtggttttagttcaattttttttagagaggaggcatctgacgggccttaaactgaggaccttagagtacaaacaaggttcgacgaaagtaagtttaagggatacaaggccgtagccaacaaaacgcgacgcagcgcgcaatctaaaatcagcgtgctgtcaaggtagctggagacgtccatgccgttaatctctctcaagaagctcgccgaagctcagtgcaccttgcgtgcactcttgtgaagagcaccttcacgtgtcctttgtcctgagattttgtcaacagtttccatgactgcaagaaaaacactagtttgtataatagctcagcgggatgtcgaatgaattgcccctcaatcaaagctttatttctag

SEQ ID NO: 118 - protein, 349 aa, Hordeum vulgare
MGGLSMGQAFVQAPEHRTKPTLADADGIPVIDLSPLAAGDEAGVDALAAEVGRASRDWGFFVVVRHGVPAETVARALEAQRAFFALPAERKAAVRRDEAAPLGYYESEHTKNVRDWKEVFDFVPREPPPPAAVADGELVFENKWPEDLPGFRVAFEEYAKAMEELAFKLLELIARSLGLTPDRLNGFFKDHQTTFIRLNHYPPCPSPDLALGVGRHKDAGALTVLYQDDVGGLDVRHRSDGEWVRVRPVPDSYVINVGDIIQVWSNDRYESAEHRVSVNSDKERFSMPYFFNPGSDAMVEPLEEMVSDERPARYDAYNWGHFFSTRKNSNFKKLDVENVQIAHFRKLHL

SEQ ID NO: 119 - DNA, 1963 bp, Sorghum bicolor
tataaataccacgccatgtacttctctgcttctacacttctccagcttctctcatgccataccactagtgcaaggtcctagatttacacttggtgctacagcttcttcctccctccctcccctctctaggcagctagcacgcagcgcagcacacgaaacatctattgaccggccgcctccgccggggatccataattactatactaccaatcggccagcgtcatgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctccccgcccatctcctccttcttctccaagtgcatgtggtcggagggatacaccttctcgccggccaacctccgcgccgacctccgcaagctctggcctaaggccggcgacgactacaccagcttctgtgatgtgatggaggagttccacaagcacatgcgtgccctcgcggacaagctgctggagctgttcctcatggcgctggggctcaccgacgagcaggtcggcggcgtggaggcggagcggaggatcgccgagacgatgaccgccaccatgcacctcaactggtaccctcggtgcccggacccgcgccgcgcgctggggctgatcgcgcacaccgactcgggcttcttcaccttcgtgctgcagagcctcgtcccggggctgcagctcttccgccacgccccggaccggtgggtggcggtgccggcggtaccgggcgccttcgtcgtcaacgtgggcgacctcttccacatcctcaccaacggccggttccacagcgtgtaccaccgcgccgtcgtgaaccgggacctcgacaggatatctctcggctacttcctcggcccgccgccgcacgccaaggtggcgccgctaagggaggccgtgccgcccggccgcacccccgcgtaccgcgccgtcacgtggcccgagtacatgggcgtccgcaagaaggccttcaccaccggcgcatccgcgctcaagatggtcgccctcgccgccgccgccgccgccgccgacctcgacgatgacgccggtgctggcgccgccgccgaacctgtcgtccatcagcagctactcgtctcgtcgtagccgatcgatcgccggatcggtcgagactgatgatgatgatgcatatatactcgtcgatggagtagacagactaatcaagcaaccctgaaactatgaatgcatgcgtgcgcttcgtgcttgcttgcgcatgcagctagcaggcttcattccgttccgcagctgctctgctccaacctgctctgctggattgatgtatatggtagaagaattaagagatcgatggatgacggaggaagaagaagacgaagacgacgatgaggaaaaggacacgctgtacgtagctggttcttctagtctagtttacagcaggccgggcggccggctgctgcttccaatcgagtttgtcgttactgacgattgttagtggatcgattaactaatctggaattctggattattaatataatgcatgtggtttggcatctggcgtaaagcaggtaatggtacctagccagtagccagtagccaggctggtcaatgataggtctataccctgatcctgtactgttgtttctttcggtctttctgagagagaaaaaaaacgaatatatggcgtactcaattcatcaaa

SEQ ID NO: 120 - DNA, 1170 bp, Sorghum bicolor
atgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctccccgcccatctcctccttcttctccaagtgcatgtggtcggagggatacaccttctcgccggccaacctccgcgccgacctccgcaagctctggcctaaggccggcgacgactacaccagcttctgtgatgtgatggaggagttccacaagcacatgcgtgccctcgcggacaagctgctggagctgttcctcatggcgctggggctcaccgacgagcaggtcggcggcgtggaggcggagcggaggatcgccgagacgatgaccgccaccatgcacctcaactggtaccctcggtgcccggacccgcgccgcgcgctggggctgatcgcgcacaccgactcgggcttcttcaccttcgtgctgcagagcctcgtcccggggctgcagctcttccgccacgccccggaccggtgggtggcggtgccggcggtaccgggcgccttcgtcgtcaacgtgggcgacctcttccacatcctcaccaacggccggttccacagcgtgtaccaccgcgccgtcgtgaaccgggacctcgacaggatatctctcggctacttcctcggcccgccgccgcacgccaaggtggcgccgctaagggaggccgtgccgcccggccgcacccccgcgtaccgcgccgtcacgtggcccgagtacatgggcgtccgcaagaaggccttcaccaccggcgcatccgcgctcaagatggtcgccctcgccgccgccgccgccgccgccgacctcgacgatgacgccggtgctggcgccgccgccgaacctgtcgtccatcagcagctactcgtctcgtcgtag

SEQ ID NO: 121 - protein, 389 aa, Sorghum bicolor
MPTPSHLANPRYFDFRAARRVPETHAWPGLHDHPVVDGGAPGPDAVPVVDLAGAADEPRAAVVAQVARAAEQWGAFLLTGHGVPAELLARVEDRIATMFALPADDKMRAVRGPGDACGYGSPPISSFFSKCMWSEGYTFSPANLRADLRKLWPKAGDDYTSFCDVMEEFHKHMRALADKLLELFLMALGLTDEQVGGVEAERRIAETMTATMHLNWYPRCPDPRRALGLIAHTDSGFFTFVLQSLVPGLQLFRHAPDRWVAVPAVPGAFVVNVGDLFHILTNGRFHSVYHRAVVNRDLDRISLGYFLGPPPHAKVAPLREAVPPGRTPAYRAVTWPEYMGVRKKAFTTGASALKMVALAAAAAAADLDDDAGAGAAAEPVVHQQLLVSS

SEQ ID NO: 122 - DNA, 2321 bp, Sorghum bicolor
tataaataccacgccatgtacttctctgcttctacacttctccagcttctctcatgccataccactagtgcaaggtcctagatttacacttggtgctacagcttcttcctccctccctcccctctctaggcagctagcacgcagcgcagcacacgaaacatctattgaccggccgcctccgccggggatccataattactatactaccaatcggccagcgtcatgccgacgccgtcgcacctcgcgaacccgcgctacttcgacttccgtgcggcgcggcgggtgccggagacgcacgcctggccggggctgcacgaccaccccgtcgtggacggcggcgcgccggggccagacgccgtccccgtggtggacctcgcgggggcggcggacgagccgagagccgcggtggtggcccaagtggcgcgcgccgccgagcaatggggcgcgttcctgctcacggggcacggcgtccccgcggagctgctggcgcgcgtcgaggaccggatcgccaccatgttcgcgctgccagcggacgacaagatgcgcgccgtgcgcgggcctggcgacgcctgcggctacggctccccgcccatctcctccttcttctccaagtgcatgtggtcggagggatacaccttctcgccggccaacctccgcgccgacctccgcaagctctggcctaaggccggcgacgactacaccagcttctggtacgtgcacccgccggccgcgcgccgccacacaccgtacccacacacgtgcgcgctcgcgcctagctactagtagctgctttgctttgcttacctttgattctcgcctttgccatgcatatgcatgatgcacgtacaggtactgcaggtacaacatgtcacacgcacgcacgcacgcacaacccatagtccgatacgatacatcatcgatcgacgtgtcgtcaccgtctaaggccatgcatgcatgcaagcacacgcctagacctttttagcatgctggctgacgaggagtatactagctaataagctacttgtcactgcgcgtcttgcttaattacactagtgcatatttctacagtgatgtgatggaggagttccacaagcacatgcgtgccctcgcggacaagctgctggagctgttcctcatggcgctggggctcaccgacgagcaggtcggcggcgtggaggcggagcggaggatcgccgagacgatgaccgccaccatgcacctcaactggtaccctcggtgcccggacccgcgccgcgcgctggggctgatcgcgcacaccgactcgggcttcttcaccttcgtgctgcagagcctcgtcccggggctgcagctcttccgccacgccccggaccggtgggtggcggtgccggcggtaccgggcgccttcgtcgtcaacgtgggcgacctcttccacatcctcaccaacggccggttccacagcgtgtaccaccgcgccgtcgtgaaccgggacctcgacaggatatctctcggctacttcctcggcccgccgccgcacgccaaggtggcgccgctaagggaggccgtgccgcccggccgcacccccgcgtaccgcgccgtcacgtggcccgagtacatgggcgtccgcaagaaggccttcaccaccggcgcatccgcgctcaagatggtcgccctcgccgccgccgccgccgccgccgacctcgacgatgacgccggtgctggcgccgccgccgaacctgtcgtccatcagcagctactcgtctcgtcgtagccgatcgatcgccggatcggtcgagactgatgatgatgatgcatatatactcgtcgatggagtagacagactaatcaagcaaccctgaaactatgaatgcatgcgtgcgcttcgtgcttgcttgcgcatgcagctagcaggcttcattccgttccgcagctgctctgctccaacctgctctgctggattgatgtatatggtagaagaattaagagatcgatggatgacggaggaagaagaagacgaagacgacgatgaggaaaaggacacgctgtacgtagctggttcttctagtctagtttacagcaggccgggcggccggctgctgcttccaatcgagtttgtcgttactgacgattgttagtggatcgattaactaatctggaattctggattattaatataatgcatgtggtttggcatctggcgtaaagcaggtaatggtacctagccagtagccagtagccaggctggtcaatgataggtctataccctgatcctgtactgttgtttctttcggtctttctgagagagaaaaaaaacgaatatatggcgtactcaattcatcaaa

SEQ ID NO: 123 - DNA, 1796 bp, Setaria italica
actagtgcaaggtcctagatttacacttggtgcttgcttgtttcttcctagttgctactggtagcacgcagtggctggctggccgtaatctattgtctgggctcgatcggtgattaggaagtagccaaagcaagctaaggccgccgccgccgccgccatgccgacgccgtcgcacctcaagaacccgctctacttcgacttccgcgccgcgcggcgggtgccggagtcccacgcctggccggggctcgacgaccaccccgtggtggacggcggcggcgcgccggggtccccggacgccgtgccggtggtggacctgcgcgagccgggcgccgcggcggtggcccgcgtggcgcgcgccgccgagcagtggggcgcgttcctgctcaccggccacggcgtccccgcggagctcctggcgcgcgtcgaggaccgcgtcgcgtgcatgttcgcgctgccggccgccgacaagatgcgcgccgtgcgcgggccgggggacgcctgcggctacggctcgccgcccatctcctccttcttctccaagtgcatgtggtccgagggctacaccttctcgccggcctccctccgccgcgacctccgcaagctctggcccaaggccggcgacgactacgacagcttctgtgacgtgatggaggagttccacaaggagatgcgcgccctcgccgacaggctcctggagctgttcctcagggcgctcgggctcaccggcgagcaggtcggcgccgtcgaggcggagcggaggatcggcgagacgatgaccgccaccatgcacctcaactggtatccgaggtgcccggacccgcggcgcgcgctggggctgatcgcgcacacggactcgggcttcttcaccttcgtgctgcagagcctcgtgccggggctgcagctgttccggcacggccccaaccggtgggtggcggtgccggccgtgccgggcgccttcgtcgtcaacgtcggcgacctcttccacatcctcacgaacggccgcttccacagcgtgtaccaccgcgccgtcgtcaaccgggacctcgaccggatatcgctcggctacttcctcggcccgccgccccacgccaaggtggcgccgctccgggaggtcgtgccgccgggccgggcccccgcctaccgcgccgtcacgtggcccgagtacatgggcgtccgcaagaaggccttcaccaccggcgcctccgcgctcaagatggtcgccgccgccgccgccgccaccgaatccgacgacaccgacgcagccgccgccgccgttcaccagccgccggtcgtcgtctcatcgtagccgatcgatcgccggaaacacagacgatgcataccgtaccccgagcaatctaatcaaaacaaggcatccattctcgcgcgcatgcagcggccagccgggcttccgcagctgctcggcctcctctgctggctgtggaaatggaaaattttaatctgagatgaagacgaagacgaagacgaaacggagaggaaaaggacatgctgtagctgtttcttctagttgcgcaggccgctcccagtcgagtttgtcgttactgacgattattactctgatgaaaactaatctgaattaatgcatgtagtttggcaatttggtactaaaggtaggcacctagccaggctggtcaatgataggtctataacctgatcctgttctctgttgttttcctttgtctgagaaaaaatggaaataattgatccggccggacgggtgtactgataggtgatgctgaattgctgatgcaagaggttgcgagctgcagtgagcagca

SEQ ID NO: 124 - DNA, 1149 bp, Setaria italica
atgccgacgccgtcgcacctcaagaacccgctctacttcgacttccgcgccgcgcggcgggtgccggagtcccacgcctggccggggctcgacgaccaccccgtggtggacggcggcggcgcgccggggtccccggacgccgtgccggtggtggacctgcgcgagccgggcgccgcggcggtggcccgcgtggcgcgcgccgccgagcagtggggcgcgttcctgctcaccggccacggcgtccccgcggagctcctggcgcgcgtcgaggaccgcgtcgcgtgcatgttcgcgctgccggccgccgacaagatgcgcgccgtgcgcgggccgggggacgcctgcggctacggctcgccgcccatctcctccttcttctccaagtgcatgtggtccgagggctacaccttctcgccggcctccctccgccgcgacctccgcaagctctggcccaaggccggcgacgactacgacagcttctgtgacgtgatggaggagttccacaaggagatgcgcgccctcgccgacaggctcctggagctgttcctcagggcgctcgggctcaccggcgagcaggtcggcgccgtcgaggcggagcggaggatcggcgagacgatgaccgccaccatgcacctcaactggtatccgaggtgcccggacccgcggcgcgcgctggggctgatcgcgcacacggactcgggcttcttcaccttcgtgctgcagagcctcgtgccggggctgcagctgttccggcacggccccaaccggtgggtggcggtgccggccgtgccgggcgccttcgtcgtcaacgtcggcgacctcttccacatcctcacgaacggccgcttccacagcgtgtaccaccgcgccgtcgtcaaccgggacctcgaccggatatcgctcggctacttcctcggcccgccgccccacgccaaggtggcgccgctccgggaggtcgtgccgccgggccgggcccccgcctaccgcgccgtcacgtggcccgagtacatgggcgtccgcaagaaggccttcaccaccggcgcctccgcgctcaagatggtcgccgccgccgccgccgccaccgaatccgacgacaccgacgcagccgccgccgccgttcaccagccgccggtcgtcgtctcatcgtag

SEQ ID NO: 125 - protein, 382 aa, Setaria italica
MPTPSHLKNPLYFDFRAARRVPESHAWPGLDDHPVVDGGGAPGSPDAVPVVDLREPGAAAVARVARAAEQWGAFLLTGHGVPAELLARVEDRVACMFALPAADKMRAVRGPGDACGYGSPPISSFFSKCMWSEGYTFSPASLRRDLRKLWPKAGDDYDSFCDVMEEFHKEMRALADRLLELFLRALGLTGEQVGAVEAERRIGETMTATMHLNWYPRCPDPRRALGLIAHTDSGFFTFVLQSLVPGLQLFRHGPNRWVAVPAVPGAFVVNVGDLFHILTNGRFHSVYHRAVVNRDLDRISLGYFLGPPPHAKVAPLREVVPPGRAPAYRAVTWPEYMGVRKKAFTTGASALKMVAAAAAATESDDTDAAAAAVHQPPVVVSS

SEQ ID NO: 126 - DNA, 2146 bp, Setaria italica
actagtgcaaggtcctagatttacacttggtgcttgcttgtttcttcctagttgctactggtagcacgcagtggctggctggccgtaatctattgtctgggctcgatcggtgattaggaagtagccaaagcaagctaaggccgccgccgccgccgccatgccgacgccgtcgcacctcaagaacccgctctacttcgacttccgcgccgcgcggcgggtgccggagtcccacgcctggccggggctcgacgaccaccccgtggtggacggcggcggcgcgccggggtccccggacgccgtgccggtggtggacctgcgcgagccgggcgccgcggcggtggcccgcgtggcgcgcgccgccgagcagtggggcgcgttcctgctcaccggccacggcgtccccgcggagctcctggcgcgcgtcgaggaccgcgtcgcgtgcatgttcgcgctgccggccgccgacaagatgcgcgccgtgcgcgggccgggggacgcctgcggctacggctcgccgcccatctcctccttcttctccaagtgcatgtggtccgagggctacaccttctcgccggcctccctccgccgcgacctccgcaagctctggcccaaggccggcgacgactacgacagcttctggtacgtcgtcgtctatagctagtagctagccgccggcacacgtgcgcctgacctgctccgccatgcatggtgcacgtatgcagatcgatcacacgcaccgatcgatcgacgtgtcccggtcaaggccatgcatgcatgcaagcaaccaacagcacgcctcctgatactgcttgttgcttacaccgttggtatgtgcctgttgcctacagtgacgtgatggaggagttccacaaggagatgcgcgccctcgccgacaggctcctggagctgttcctcagggcgctcgggctcaccggcgagcaggtcggcgccgtcgaggcggagcggaggatcggcgagacgatgaccgccaccatgcacctcaactggtatgtgccatgccatgaccacctgcgtctatgaactaacggaagcttccatcgcgtgtccatgacgatttagaagctgtagtccagagcttgagacaaacgaaacgaagcttacatggtggcgtgacgtgtcgcgtgcaggtatccgaggtgcccggacccgcggcgcgcgctggggctgatcgcgcacacggactcgggcttcttcaccttcgtgctgcagagcctcgtgccggggctgcagctgttccggcacggccccaaccggtgggtggcggtgccggccgtgccgggcgccttcgtcgtcaacgtcggcgacctcttccacatcctcacgaacggccgcttccacagcgtgtaccaccgcgccgtcgtcaaccgggacctcgaccggatatcgctcggctacttcctcggcccgccgccccacgccaaggtggcgccgctccgggaggtcgtgccgccgggccgggcccccgcctaccgcgccgtcacgtggcccgagtacatgggcgtccgcaagaaggccttcaccaccggcgcctccgcgctcaagatggtcgccgccgccgccgccgccaccgaatccgacgacaccgacgcagccgccgccgccgttcaccagccgccggtcgtcgtctcatcgtagccgatcgatcgccggaaacacagacgatgcataccgtaccccgagcaatctaatcaaaacaaggcatccattctcgcgcgcatgcagcggccagccgggcttccgcagctgctcggcctcctctgctggctgtggaaatggaaaattttaatctgagatgaagacgaagacgaagacgaaacggagaggaaaaggacatgctgtagctgtttcttctagttgcgcaggccgctcccagtcgagtttgtcgttactgacgattattactctgatgaaaactaatctgaattaatgcatgtagtttggcaatttggtactaaaggtaggcacctagccaggctggtcaatgataggtctataacctgatcctgttctctgttgttttcctttgtctgagaaaaaatggaaataattgatccggccggacgggtgtactgataggtgatgctgaattgctgatgcaagaggttgcgagctgcagtgagcagca

SEQ ID NO: 127 - DNA, 1933 bp, Oryza sativa
actactcattccactattgtaaagtcatagaaaaaatttatatagagagaaaaaattagtgttgttattgttactggctttctgccagacgagacgagcgagcgcgcgagtgtgttgctctctggtcatcgtcgtcgtcgtcgcgatgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctgtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataagctatagctactagctacctcgatctcacgcaaaaaaaaaaagaaacaattaatagagcaaaaaaaaaaagaagagaaaatggtggtacttgtgtttaaggtttcctccatgcaaaatggtttgcatgcatgcatgcaaagctagcatctgcagctgcaagaattacaagagcagagaagcagacagctagatggagataattaattaattaattaatctaattaagcatgcaataattaagattattattctgatttcagaactgaaaaaaaaagtgtggttaattaattattggttaggcttaattttatctagatgtagaaaaagaatcaagatcttcaagcaagagagaagaggatcgaagaagaaggaaaagaaaacgaaaaggacatgctgtgttgtctcttctagttgtaccctggctgctgattaagtgctttgttttgttgctgcaagcttgtcgttactgattattagttagttatgcatctaattgattaaactaatctgtttggcattttggctcgagctaagctatagccaggctggtcaatgataggaacttgtacaatttaagcaattgaacctgatcctgtactggcatgtatgtatatatgcaagtgatgagaaccactagctagtatagctagacatgtatttgtata

SEQ ID NO: 128 - DNA, 1122 bp, Oryza sativa
atgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctgtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataa

SEQ ID NO: 129 - protein, 373 aa, Oryza sativa
MPTPSHLKNPLCFDFRAARRVPETHAWPGLDDHPVVDGGGGGGEDAVPVVDVGAGDAAARVARAAEQWGAFLLVGHGVPAALLSRVEERVARVFSLPASEKMRAVRGPGEPCGYGSPPISSFFSKLMWSEGYTFSPSSLRSELRRLWPKSGDDYLLFCDVMEEFHKEMRRLADELLRLFLRALGLTGEEVAGVEAERRIGERMTATVHLNWYPRCPEPRRALGLIAHTDSGFFTFVLQSLVPGLQLFRRGPDRWVAVPAVAGAFVVNVGDLFHILTNGRFHSVYHRAVVNRDRDRVSLGYFLGPPPDAEVAPLPEAVPAGRSPAYRAVTWPEYMAVRKKAFATGGSALKMVSTDAAAAADEHDDVAAAADVHA

SEQ ID NO: 130 - DNA, 2040 bp, Oryza sativa
actactcattccactattgtaaagtcatagaaaaaatttatatagagagaaaaaattagtgttgttattgttactggctttctgccagacgagacgagcgagcgcgcgagtgtgttgctctctggtcatcgtcgtcgtcgtcgcgatgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctggtatatatacatatatactctcccatgcattccatgcacatacactctacgtatatatctacctctacgtatatatctacgtattgatctacgtataatatacgcagtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataagctatagctactagctacctcgatctcacgcaaaaaaaaaaagaaacaattaatagagcaaaaaaaaaaagaagagaaaatggtggtacttgtgtttaaggtttcctccatgcaaaatggtttgcatgcatgcatgcaaagctagcatctgcagctgcaagaattacaagagcagagaagcagacagctagatggagataattaattaattaattaatctaattaagcatgcaataattaagattattattctgatttcagaactgaaaaaaaaagtgtggttaattaattattggttaggcttaattttatctagatgtagaaaaagaatcaagatcttcaagcaagagagaagaggatcgaagaagaaggaaaagaaaacgaaaaggacatgctgtgttgtctcttctagttgtaccctggctgctgattaagtgctttgttttgttgctgcaagcttgtcgttactgattattagttagttatgcatctaattgattaaactaatctgtttggcattttggctcgagctaagctatagccaggctggtcaatgataggaacttgtacaatttaagcaattgaacctgatcctgtactggcatgtatgtatatatgcaagtgatgagaaccactagctagtatagctagacatgtatttgtata

SEQ ID NO: 131 - DNA, 1332 bp, Hordeum vulgare
acactcactcctcaatccatccgtctccaccattgctcgctagctcgagctctactagctagcactgcaaagtcagccgggccggagttgatttggtccttgttagcttgaccgatcgtatacgtatcgccaggatgccgacgccgtcgcacctgagcaaggacccgcactacttcgacttccgggcggcgcggcgggtgccggagacacacgcgtggccggggctgcacgaccacccggtggtggacggcggcggcgcgggcggagggccggacgcggtgccggtggtggacatgcgcgacccgtgcgccgcggaggcggtggcgctggccgcgcaggactggggcgccttcctcttgcagggccacggcgtcccgttggagctgctggcccgcgtggaggccgcgatagcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgtgccgtgatggaggagttccacagggagatgcgcgttctggccgacaagctgctggagctgttcctggtggccctcgggctcaccggcgagcaggtcgccgccgtcgagtcggagcacaagatcgccgagaccatgaccgccacaatgcacctcaactggtaccccaagtgcccggacccgaagcgagcgctgggcctgatcgcgcacacggactcgggcttcttcaccttcgtgctccagagcctggtgcccgggctgcagctgttccggcacggccccgaccgttgggtgacggtgcccgccgtgccgggcgccatggtcgtcaacgtcggcgacctcttccacatcctcaccaatggccgcttccacagcgtctaccaccgcgccgtcgtcaaccgcgacagcgaccggatatcgctggggtacttcctcggcccgcccgcccacgttaaggtggcgccgctcagggaggccctcgccggcacgcccgctgcctaccgcgccgtcacgtggcccgagtacatgggcgtgcgcaagaaggccttcaccaccggcgcctccgcgctcaagatggtcgccatctccaccgacgacgccgccgacgtcctccccgacgtcctctcgtcgtagatcggcgccggccatcacccggccggccaagagaccgatctatacaaacaattagtgaacaaaaaaaaaaaaaaaaaaaaaaaaaaaa

SEQ ID NO: 132 - DNA, 1110 bp, Hordeum vulgare
atgccgacgccgtcgcacctgagcaaggacccgcactacttcgacttccgggcggcgcggcgggtgccggagacacacgcgtggccggggctgcacgaccacccggtggtggacggcggcggcgcgggcggagggccggacgcggtgccggtggtggacatgcgcgacccgtgcgccgcggaggcggtggcgctggccgcgcaggactggggcgccttcctcttgcagggccacggcgtcccgttggagctgctggcccgcgtggaggccgcgatagcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgtgccgtgatggaggagttccacagggagatgcgcgttctggccgacaagctgctggagctgttcctggtggccctcgggctcaccggcgagcaggtcgccgccgtcgagtcggagcacaagatcgccgagaccatgaccgccacaatgcacctcaactggtaccccaagtgcccggacccgaagcgagcgctgggcctgatcgcgcacacggactcgggcttcttcaccttcgtgctccagagcctggtgcccgggctgcagctgttccggcacggccccgaccgttgggtgacggtgcccgccgtgccgggcgccatggtcgtcaacgtcggcgacctcttccacatcctcaccaatggccgcttccacagcgtctaccaccgcgccgtcgtcaaccgcgacagcgaccggatatcgctggggtacttcctcggcccgcccgcccacgttaaggtggcgccgctcagggaggccctcgccggcacgcccgctgcctaccgcgccgtcacgtggcccgagtacatgggcgtgcgcaagaaggccttcaccaccggcgcctccgcgctcaagatggtcgccatctccaccgacgacgccgccgacgtcctccccgacgtcctctcgtcgtag

SEQ ID NO: 133 - protein, 369 aa, Hordeum vulgare
MPTPSHLSKDPHYFDFRAARRVPETHAWPGLHDHPVVDGGGAGGGPDAVPVVDMRDPCAAEAVALAAQDWGAFLLQGHGVPLELLARVEAAIAGMFALPASEKMRAVRRPGDSCGYGSPPISSFFSKCMWSEGYTFSPANLRSDLRKLWPKAGHDYRHFCAVMEEFHREMRVLADKLLELFLVALGLTGEQVAAVESEHKIAETMTATMHLNWYPKCPDPKRALGLIAHTDSGFFTFVLQSLVPGLQLFRHGPDRWVTVPAVPGAMVVNVGDLFHILTNGRFHSVYHRAVVNRDSDRISLGYFLGPPAHVKVAPLREALAGTPAAYRAVTWPEYMGVRKKAFTTGASALKMVAISTDDAADVLPDVLSS

SEQ ID NO: 134 - DNA, 1653 bp, Triticum aestivum
  misc_feature (1594)..(1600): n is a, c, g, or t
  misc_feature (1641)..(1641): n is a, c, g, or t
cacgagatccatccgtctccaccattgctcgctagctcgagctcctagctagtactgcaaagtcagccggggagttgatttggtccttcttggcttgaccgatcgtacgtgccgccaggatgccgacgccggcgcacctgagcaaggacccgcgctacttcgacttccgggcggcgcggcgggtgccggagacgcacgcgtggcccgggctgcacgaccaccccgtggtggacggcagcggcgcgggcggagggccggacgcggtgccggtggtggacatgcgcgacccgtgcgcggcggaggcggtggcgctggcggcgcaggactggggcgccttcctcctggagggccacggcgtcccgttggagctgctggcgcgcgtggaggccgcgatcgcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgcgccgtgatggaggagttccacagggagatgcgcgcgctggccgacaagctgctggagctgttcctggtggccctcgggctcaccggcgagcaggtcgccgccgtcgagtccgagcagaagatcgccgagaccatgaccgccacaatgcacctcaactggtaccccaagtgcccggacccgaagcgggcgctgggcctgatcgcgcacacggactcgggcttcttcaccttcgtgctgcagagccttgtgcccgggctgcagctgttccggcacggccccgaccggtgggtgacggtgcccgccgtgccgggggccatggtcgtcaacgtcggcgacctcttccagatcctcaccaacggccgcttccacagcgtctaccaccgcgccgtcgtcaaccgcgacagcgaccggatatcgctcggctacttcctcggcccgcccgcccacgtcaaggtggcgccgctcagggaggccctggccggcacgcccgccgcctaccgcgccgtcacgtggcccgagtacatgggcgtgcgcaagaaggccttcaccaccggcgcctccgcgctcaagatggtcgccatctccactgacaacgacgccgccaaccacacggacgacctgatctcgtcgtagatcggcgccggccatcaccggccggccaagggatcgatctacacacacaattagtgaacaaaaaaatgccagagatggtgcatggtgggctggtagcttagctgaggtagctaggaggaagagcgcgcgtgcggctgtcgttcgtgcggctgttcccgcaaaaaaaaaaaaggtttcctccatatatgtctccatgcagaactgcagatgctggtggtggatgcgtccatgcagcagggaacgaactaattgtaagaaaatcaagcaaacttagttctacatctgtaattaagtatgcatgccacttggtttaattcaattcaagtgcagaaaaaattatgatgggaaaaaaaaagacatgnnnnnnnaaaaaaaaaaaaaaaaaaaaaaaaaaaaaaaaaaaaaaaanaaaaaaaaaaaa

SEQ ID NO: 135 - DNA, 1113 bp, Triticum aestivum
atgccgacgccggcgcacctgagcaaggacccgcgctacttcgacttccgggcggcgcggcgggtgccggagacgcacgcgtggcccgggctgcacgaccaccccgtggtggacggcagcggcgcgggcggagggccggacgcggtgccggtggtggacatgcgcgacccgtgcgcggcggaggcggtggcgctggcggcgcaggactggggcgccttcctcctggagggccacggcgtcccgttggagctgctggcgcgcgtggaggccgcgatcgcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctgcgccgtgatggaggagttccacagggagatgcgcgcgctggccgacaagctgctggagctgttcctggtggccctcgggctcaccggcgagcaggtcgccgccgtcgagtccgagcagaagatcgccgagaccatgaccgccacaatgcacctcaactggtaccccaagtgcccggacccgaagcgggcgctgggcctgatcgcgcacacggactcgggcttcttcaccttcgtgctgcagagccttgtgcccgggctgcagctgttccggcacggccccgaccggtgggtgacggtgcccgccgtgccgggggccatggtcgtcaacgtcggcgacctcttccagatcctcaccaacggccgcttccacagcgtctaccaccgcgccgtcgtcaaccgcgacagcgaccggatatcgctcggctacttcctcggcccgcccgcccacgtcaaggtggcgccgctcagggaggccctggccggcacgcccgccgcctaccgcgccgtcacgtggcccgagtacatgggcgtgcgcaagaaggccttcaccaccggcgcctccgcgctcaagatggtcgccatctccactgacaacgacgccgccaaccacacggacgacctgatctcgtcgtag

SEQ ID NO: 136 - protein, 370 aa, Triticum aestivum
MPTPAHLSKDPRYFDFRAARRVPETHAWPGLHDHPVVDGSGAGGGPDAVPVVDMRDPCAAEAVALAAQDWGAFLLEGHGVPLELLARVEAAIAGMFALPASEKMRAVRRPGDSCGYGSPPISSFFSKCMWSEGYTFSPANLRSDLRKLWPKAGHDYRHFCAVMEEFHREMRALADKLLELFLVALGLTGEQVAAVESEQKIAETMTATMHLNWYPKCPDPKRALGLIAHTDSGFFTFVLQSLVPGLQLFRHGPDRWVTVPAVPGAMVVNVGDLFQILTNGRFHSVYHRAVVNRDSDRISLGYFLGPPAHVKVAPLREALAGTPAAYRAVTWPEYMGVRKKAFTTGASALKMVAISTDNDAANHTDDLISS

SEQ ID NO: 137 - DNA, 1884 bp, Triticum aestivum
tatatatacagctccttgtacttctctcgttcttacactcactcctcaatccatccgtctccaccattgctcgctagctcgagctcctagctagtactgcaaagtcagccggggagttgatttggtccttcttggcttgaccgatcgtacgtgccgccaggatgccgacgccggcgcacctgagcaaggacccgcgctacttcgacttccgggcggcgcggcgggtgccggagacgcacgcgtggcccgggctgcacgaccaccccgtggtggacggcagcggcgcgggcggagggccggacgcggtgccggtggtggacatgcgcgacccgtgcgcggcggaggcggtggcgctggcggcgcaggactggggcgccttcctcctggagggccacggcgtcccgttggagctgctggcgcgcgtggaggccgcgatcgcgggcatgttcgcgctgccggcgtcggagaagatgcgcgccgtgcggcggcccggcgactcgtgcggctacgggtcgccgcccatctcctccttcttctccaagtgcatgtggtccgagggctacaccttctccccggccaacctccgctccgacctccgcaagctctggcccaaggccggccacgactaccgccacttctggtacgtacgccggccgccgatgcgcatatacacgtcatagtacggcacctacctaactggctctggccaaccgtccgtacacacgtgaaggggcgacgtgtccgactccgaccatgcatgcatgcacgcgcgcgaaacttgttactcctgttctgctatggcagcagctagccgcgtgtgtccgttcgtaggagtagttacttacacagttacacttacgccgtccgtcgtgttcctcgacgtgcagcgccgtgatggaggagttccacagggagatgcgcgcgctggccgacaagctgctggagctgttcctggtggccctcgggctcaccggcgagcaggtcgccgccgtcgagtccgagcagaagatcgccgagaccatgaccgccacaatgcacctcaactggtacgttccactactactccagtagtacaagtacaatatatagaatacaaatggcagcagccacgacgacacgtactccaccatgcagcaaagcatatattgtcggtgcggcggttgacacggagttgtgtcgtgtcgttgattcacaggtaccccaagtgcccggacccgaagcgggcgctgggcctgatcgcgcacacggactcgggcttcttcaccttcgtgctgcagagccttgtgcccgggctgcagctgttccggcacggccccgaccggtgggtgacggtgcccgccgtgccgggggccatggtcgtcaacgtcggcgacctcttccagatcctcaccaacggccgcttccacagcgtctaccaccgcgccgtcgtcaaccgcgacagcgaccggatatcgctcggctacttcctcggcccgcccgcccacgtcaaggtggcgccgctcagggaggccctggccggcacgcccgccgcctaccgcgccgtcacgtggcccgagtacatgggcgtgcgcaagaaggccttcaccaccggcgcctccgcgctcaagatggtcgccatctccactgacaacgacgccgccaaccacacggacgacctgatctcgtcgtagatcggcgccggccatcaccggccggccaagggatcgatctacacacacaattagtgaacaaaaaaatgccagagatggtgcatggtgggctggtagcttagctgaggtagctaggaggaagagcgcgcgtgcggctgtcgttcgtgcggctgttcccgcaaaaaaaaaaaggtttcctccatatakgtccccakscaaaatsgmaawgctgggg

SEQ ID NO: 138 - RNA, 20 nt, Artificial Sequence
  suppression oligo
acggguucuuccaggugugc

SEQ ID NO: 139 - RNA, 20 nt, Artificial Sequence
  suppression oligo
cacggguucuuccaggugug

SEQ ID NO: 140 - RNA, 20 nt, Artificial Sequence
  suppression oligo
cauugaccuccccgcuggca

SEQ ID NO: 141 - RNA, 20 nt, Artificial Sequence
  suppression oligo
ccagcggggaggucaaugcu

SEQ ID NO: 142 - RNA, 20 nt, Artificial Sequence
  suppression oligo
cccagcauugaccuccccgc

SEQ ID NO: 143 - RNA, 20 nt, Artificial Sequence
  suppression oligo
cgcgcucguguacccggaca

SEQ ID NO: 144 - RNA, 20 nt, Artificial Sequence
  suppression oligo
cucccggcgcaggucgaaca

SEQ ID NO: 145 - RNA, 20 nt, Artificial Sequence
  suppression oligo
guguacccggacacggugcc

SEQ ID NO: 146 - RNA, 20 nt, Artificial Sequence
  suppression oligo
ugcagggaagcuguccgggc

SEQ ID NO: 147 - RNA, 20 nt, Artificial Sequence
  suppression oligo
uucuuccaggugugcgggca

SEQ ID NO: 148 - RNA, 20 nt, Artificial Sequence
  suppression oligo
agauccccgcgccauuccug

SEQ ID NO: 149 - RNA, 20 nt, Artificial Sequence
  suppression oligo
augcagggaagcuguccggg

SEQ ID NO: 150 - RNA, 20 nt, Artificial Sequence
  suppression oligo
auuccuguggccgcaggaag

SEQ ID NO: 151 - RNA, 20 nt, Artificial Sequence
  suppression oligo
cagcggggaggucaaugcug

SEQ ID NO: 152 - RNA, 20 nt, Artificial Sequence
  suppression oligo
caggaauggcgcggggaucu

SEQ ID NO: 153 - RNA, 20 nt, Artificial Sequence
  suppression oligo
gacuacuucgucggcacccu

SEQ ID NO: 154 - RNA, 20 nt, Artificial Sequence
  suppression oligo
gccaggauuucgagccaaug

SEQ ID NO: 155 - RNA, 20 nt, Artificial Sequence
  suppression oligo
ggaacauuuggagggaggcg

SEQ ID NO: 156 - RNA, 20 nt, Artificial Sequence
  suppression oligo
gggaggucaaugcuggggcu

SEQ ID NO: 157 - RNA, 20 nt, Artificial Sequence
  suppression oligo
uuggcucgaaauccuggccg

SEQ ID NO: 158 - RNA, 20 nt, Artificial Sequence
  suppression oligo
acggguucuuccaggugugc

SEQ ID NO: 159 - RNA, 20 nt, Artificial Sequence
  suppression oligo
cacggguucuuccaggugug

SEQ ID NO: 160 - RNA, 20 nt, Artificial Sequence
  suppression oligo
cauugaccuccccgcuggca

SEQ ID NO: 161 - RNA, 20 nt, Artificial Sequence
  suppression oligo
ccagcggggaggucaaugcu

SEQ ID NO: 162 - RNA, 20 nt, Artificial Sequence
  suppression oligo
cccagcauugaccuccccgc

SEQ ID NO: 163 - RNA, 20 nt, Artificial Sequence
  suppression oligo
cgcgcucguguacccggaca

SEQ ID NO: 164 - RNA, 20 nt, Artificial Sequence
  suppression oligo
cucccggcgcaggucgaaca

SEQ ID NO: 165 - RNA, 20 nt, Artificial Sequence
  suppression oligo
guguacccggacacggugcc

SEQ ID NO: 166 - RNA, 20 nt, Artificial Sequence
  suppression oligo
ugcagggaagcuguccgggc

SEQ ID NO: 167 - RNA, 20 nt, Artificial Sequence
  suppression oligo
uucuuccaggugugcgggca

SEQ ID NO: 168 - protein, 358 aa, Physcomitrella patens
MPKPCDACHVSSAAVFCRADAAYLCVGCDGKVHGANKLASRHERVWMCEVCEVAPAVVTCKADAASLCVACDTDIHSANPLAQRHERVPVTPLFESASPLRGPDFCVLVSENGCHDLLKGCEDASVVEAVSWLLPHPKISTNSIIRGSAAADEMGSSPFHDRPFSPKPKKQKVELPADIFSDVDPFLDLDDATVTGIQPDSLVPVHMPECSEDTDSLAHSMDPSFTKFPLSAKSGYSYGTSTLTQSISCSSLDAAVVPDSSLSDISTPYLDSQSSQDMSARLPHQTGGPIDTVDREARVLRYKEKRQKRKFEKTIRYASRKAYAESRPRIKGRFAKRTDSDMEQFGSVDSSFGVVPSF

SEQ ID NO: 169 - DNA, 1077 bp, Physcomitrella patens
atgccgaagccttgtgatgcatgccatgtttccagcgcggcggtgttctgccgagcggacgctgcctacctgtgcgtaggctgcgatgggaaggtccacggggccaacaaactagcgtctcgacacgagcgcgtgtggatgtgcgaagtgtgcgaggttgctccagccgtggtgacctgcaaggcggatgcggcttctctctgtgtggcctgtgacacagacatccactccgccaacccgctagcgcagcgtcacgagagagtgccggtgacacctctgttcgagagtgcgagtcctttgcgtgggccagatttctgcgtgttggtgtcagagaatgggtgccatgatctgctgaagggctgtgaggacgcctcggttgtggaagctgtctcgtggcttcttccgcaccctaagatctcgaccaactctattatcagaggcagcgctgcagccgacgagatgggttcgtcgcctttccacgaccggccctttagtcccaagcccaagaaacagaaggttgaattgcccgcggacatattctctgatgtggaccctttcctagacttggacgatgcaaccgttaccggaattcaacccgacagcttggtaccagtccatatgccagaatgctccgaggacacggattcgcttgctcactccatggacccttcgtttactaaatttcctctctcggcgaagagcggttacagctatggcacatctacccttactcagagcatttcttgttcgtctctagatgccgccgttgttccagactccagtctcagcgacatttccacaccctacctagactcacaaagctcccaagatatgtcagctcgcctgccacaccagactggaggtcccattgacaccgtcgaccgtgaagctcgcgtgttgcgctacaaggagaagaggcagaagcgcaagtttgagaaaacaattcgctatgcatcaaggaaggcatatgctgagagccggccgaggatcaaaggaaggttcgctaagagaactgattccgacatggagcagtttggctcagtggactcaagtttcggagtggttccaagtttttag

SEQ ID NO: 170 - DNA, 757 bp, Oryza sativa
ctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgag

SEQ ID NO: 171 - DNA, 333 bp, Cauliflower mosaic virus
catcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcga

SEQ ID NO: 172 - DNA, 80 bp, Oryza sativa
ccctccctccgcttccaaagaaacgccccccatcgccactatatacatacccccccctctcctcccatccccccaaccct

SEQ ID NO: 173 - DNA, 61 bp, Triticum aestivum
aaccatcttccacacactcaagccacactattggagaacacacagggacaacacaccataa

SEQ ID NO: 174 - DNA, 480 bp, Oryza sativa
ccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaag

SEQ ID NO: 175 - DNA, 943 bp, Solanum tuberosum
accctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcga

SEQ ID NO: 176 - protein, 337 aa, Brassica juncea
MLKQESNWAQTCDTCRSAACTVYCRPDSAYLCTSCDAQIHEANRLASRHERVRVCQSCERAPAAFFCKADAASLCTACDSQIHSANPLARRHQRVPILPISGSMVTNHSSETTEAEDIVVVGQEEEDEAEAASWLLPTSVKNCGDNNNNNNNSQDNRFSVGEEYLDLVDYSKYQQDYNVPQRRSYVADGVVPLQVEVSKSLSHMHHEQHNFQFGFTNVSSEASPIHMVSLVPESSLSETTVSNPRSPKAATEELPEAPVQMLSPMERKARVMRYREKKKTRKFEKTIRYASRKEYAEKRPRIKGRFAKRNEVDAEEADKAFSSMVMFDTGYGIEPSF

SEQ ID NO: 177 - protein, 345 aa, Oryza sativa Japonica Group
MASAAAATGAALGARTARACDGCMRRRARWHCPADDAFLCQACDASVHSANPLARRHHRVRLPSASSSPASSPRSAAAPRAGSDDPDAPAWLHGLKRRPRTPRTKPGGGGKHDASAATVAAAAASAVPDLEAEESGIVGDTDHDVGEEDDEDLLYRVPGFDDLGFLDDEKPHVKLDLDMDMDFASISPAPAPEREERKRKRPEMILKLDYEGVIDSWARDGASPWFHGERPRFDPSESWPDFPAGSRGGLGAAVTAVTGGEREARVSRYREKRRTRLFAKKIRYEVRKLNAEKRPRMKGRFVKRAAALPPLPLPRHQHPPPPPPRALPPVPMMLAPRGAHGRYRF

SEQ ID NO: 178 - protein, 410 aa, Picea abies
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 179 - protein, 410 aa, Picea abies
  misc_feature (152)..(152): Xaa can be any naturally occurring amino acid
  misc_feature (155)..(155): Xaa can be any naturally occurring amino acid
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNXLLXHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 180 - protein, 410 aa, Picea abies
  misc_feature (245)..(245): Xaa can be any naturally occurring amino acid
  misc_feature (389)..(389): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHXGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVXVEQIYSSSLLPDQGYGVVPSY

SEQ ID NO: 181 - protein, 410 aa, Picea abies
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 182 - protein, 410 aa, Picea abies
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 183 - protein, 410 aa, Picea abies
  misc_feature (151)..(152): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHXXLLNHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 184 - protein, 410 aa, Picea abies
  misc_feature (293)..(293): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNXCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 185 - protein, 410 aa, Picea abies
  misc_feature (161)..(161): Xaa can be any naturally occurring amino acid
  misc_feature (177)..(177): Xaa can be any naturally occurring amino acid
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEEDXDAEICCAEEAATASWXIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 186 - protein, 410 aa, Picea abies
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEEDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 187 - protein, 410 aa, Picea abies
  misc_feature (120)..(120): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVXLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 188 - protein, 410 aa, Picea abies
  misc_feature (118)..(118): Xaa can be any naturally occurring amino acid
  misc_feature (159)..(159): Xaa can be any naturally occurring amino acid
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCXVLLNEDGGGDDPLKHDYVDDDYDDYDDDENDHNNLLNHQEXDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 189 - protein, 410 aa, Picea abies
  misc_feature (179)..(179): Xaa can be any naturally occurring amino acid
  misc_feature (193)..(193): Xaa can be any naturally occurring amino acid
MSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIXEANRNNLTNINGGXSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 190 - protein, 410 aa, Picea abies
  misc_feature (182)..(183): Xaa can be any naturally occurring amino acid
  misc_feature (208)..(208): Xaa can be any naturally occurring amino acid
  misc_feature (226)..(226): Xaa can be any naturally occurring amino acid
  misc_feature (233)..(233): Xaa can be any naturally occurring amino acid
  misc_feature (235)..(235): Xaa can be any naturally occurring amino acid
  misc_feature (243)..(243): Xaa can be any naturally occurring amino acid
  misc_feature (248)..(248): Xaa can be any naturally occurring amino acid
  misc_feature (282)..(282): Xaa can be any naturally occurring amino acid
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEAXXNNLTNINGGNSEGEDKMVKDKLKFXAYMQSIDFLQDVENYVDXEYLGTTXTXTTPTTPTXHMGAXSMVPVHTPEVIEHSSTKVSVETARSLDVDAASKXNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 191 - protein, 417 aa, Ipomoea nil
MLKEESCEVLDLDVTIGSSSGSRSGNKQNWARVCDICRSAACSVYCRADLAYLCGGCDARVHGANTVAGRHERVLVCEACESAPATVICKADAASLCAACDSDIHSANPLARRHHRVPILPISGTLYGPPTSNPCRESSMMVGLTGDAAEEDNGFLTQDAEETTMDEDEDEAASWLLLNPNPNPNPNPVKSNNSTNMCKGGNNNNNEMSCAVEAVDAYLDLAEFSSCHNNLFEDKYSINQQQNYSVPQRNMSYRGDSIVPNHGKNQFHYTQGLQQHNHHAIFNCKEWNMRILTRDMVSISSMDVGVVPESTLSDTSISHSRASKGTIDLFSGPPIQMPPQLQLSQMDREARVLRYREKKKTRKFEKTIRYASRKAYAETRPRIKGRFAKRTDVDTEVDQIFYAPLMAESGYGIVPSF

SEQ ID NO: 192 - protein, 380 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRFAKMSETEVEDQEYNTMLMYYDTGYGIVPSFYGQNKEY

SEQ ID NO: 193 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 194 - protein, 360 aa, Solanum tuberosum
MGTENWSLTAKLCDSCKTTPATVFCRADSAFLCLGCDCKIHAANKLASRHARVWVCEVCEQAPAVVTCKADAAALCVTCDRDIHSANPLARRHERFPVVPFYDSAVAKSDGGGDADADAADDEKYFDSTSENPSQPEEEAEAASWILPIPKEGTDQYKSADYLFNDMDSYLDIDLMSCEQKPHIIHHQQHQHGHYSSDGVVPVQNNNNETSTHLPGPVVDGFPTYEIDFTGSKPYMYNFTSQSISQSVSSSSLDVGVVPDHSAMTDVSNTFVMNSSAAAGTGTDTEAVPNAVSGLDAGARVMRYRKKRKNIKIEKTIPYASTKAYAETRPKIKGRFAKRTEIEIDLLIDADASYGVVPSF

SEQ ID NO: 195 - protein, 407 aa, Oryza sativa Japonica Group
MDALCDFCREQRSMVYCRSDAASLCLSCDRNVHSANALSRRHTRTLLCDRCVGQPAAVRCLEENTSLCQNCDWNGHGAASSAAGHKRQTINCYSGCPSSAELSRIWSFSMDIPTVAAEPNCEEGINMMSINDNDVNNHCGAPEDGRLLDIASTALMSDLPTGDKFKPLIGSSSGDGMNLLPLNSDQPAEPVSTTPKAPCVTDKDMFNDGSVYGDFCVDDADLTFENYEELFGTSHVQTEQLFDDAGIDSYFEMKDVPADESNEQPKPVQPECSNVASVDSGMSNPAARADSSHCIPGRQAISNISLSFSGLTGESSAGYFQDCGVSSMILMGEPPWHPPGPESSSAGGSRDNALTRYKEKKKRRKFDKKIRYASRKARADVRKRVKGRFVKAGEAYDYDPLSQTRSY

SEQ ID NO: 196 - protein, 407 aa, Oryza sativa Japonica Group
MGALCDFCGEQRSMVYCRSDAASLCLSCDRNVHSANALSRRHTRTLLCDRCASQPAMVRCLVENASLCQNCDWNGHSAGSSAAGHKRQTINCYSGCPSSSELSKIWTFVSDIPNVAPEPNCEQGISMMSISDSGVSNQDNAAGDSSLLDIASATLMSDLGTAGKPKSLIGSSSEAGVNLLPLATDQMAGSVDSTSAKVPYTADQDMFSKDSIYEDFCVDDVDLSFENYEELFGTSHIQTEQLFDDAGIDSYFESKEIPSGNSDEPKLMQPVTSNAVSADSGMSIPGAKGDSSLCIPVRQARSSISLSFSGLTGESSAGDYQDCGVSPVLLMGEPPWHPPGPEGSFAGATRDDAITRYKEKKKRRKFDKKIRYASRKARADVRKRVKGRFVKAGEAYDYDPLCETRSY

SEQ ID NO: 197 - protein, 335 aa, Oryza sativa Japonica Group
MLKLEPEFPGLPQRCDSCRSAPCAFYCLADSAALCATCDADVHSVNPLARRHRRVPMGVVAAPGAGGAFVVRPAGGVNSSWPIREGRRCDYDDDDADAAGEEDEEATSWLLFDPLKDSSDQGLPPFGDALVADFLNLGGGAGEKEDASSSKDCSSSHGKSSEGSHEFAVPGEPVPERQGFGAVSMDITDYDASNFRRGYSFGASLGHSVSMSSLENMSTVPDCGVPDITTSYLRSSKSTIDLFTAAAGSPVAAHSIMSPPQFMGAIDREARVHRYREKRKTRRFEKTIRYASRKAYAETRPRIKGRFAKRSDTDLEVDQYFSTTADSSCGVVPTF

SEQ ID NO: 198 - protein, 335 aa, Brassica oleracea var. alboglabra
MLKQESNWAQTCDTCRSAACTVYCRADSAYLCTNCDAQVHAANRLASRHERVRVCQSCERAPAAFFCKADAASLCTACDSQIHSANPLARRHQRVPILPISGSMVTNHSSETTETEDIVVVGQEEEDEAEAASWLLPSSLKNSGDNNNNNNNNNSENRFSVGDEYVDLVDYNKYQQDYNVPQRSYVADGVVPLQVGVLKSHMHHEEHNFQFGFTNVSSEASPIHMVSLVPESTLSETTVSHPRSPKVATEELHDAPVQMLSPVERKARVMRYREKKKKRKFEKRIRYASRKEYAEKRPRIKGRFAKRNEVDAEEADKAFSSMVMFDTGYGIVPSF

SEQ ID NO: 199 - protein, 366 aa, Brassica oleracea var. alboglabra
MFKQESNNICNRENNRGAPACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNNQNNELLFSDDYLDLADYNSSMDYKFTSQYNQPRHKQDCIVPEKNYSGDRVVPLQLEETRGNLRNKQQNITYGSSGSQYNNNGSINHNAYNPSMETDFVPEQTAPDTTVSHPKTHKGKTAQLPEPLIQILSPMDREARVLRYREKKKRRKFEKTIRYASRKAYAERRPRINGRFAKMSETEVEDQEYNTMLMYCDTGYGIVPSFYGQK

SEQ ID NO: 200 - protein, 413 aa, Solanum tuberosum
MLKKEKSGGFDRSSNNWARVCDSCHSATCTVYCRADSAYLCAGCDSRIHAASLMASRHERVWVCEACERAPAAFLCKADAASLCASCDAVIHSANPLARRHHRVPIMPIPGTLYGPPAVHTVSGGSMMIGGTTGEGTEDDGFLSLTQDADDTTIDEEDENEAASWLLLNPPVKNNNKNNINNNNNNQNNNYGMLFGGEVVDEYLDLAEYGGDSQFNDQYSVNQQQQHYSVPQKSYVEDSVVPVQNGQRKSLILYHQPQQQQQQQQQSHHLNFQLGMEYDNSNTGYGYPASLSHSVSISSMDVSVVPESALSETSNSHPRPPKGTIDLFSGPPIQIPPQLTPMDREARVLRYREKKKNRKFEKTIRYASRKAYAETRPRIKGRFAKRTDVKAEVDQMFSTQLMTDSSYGIVPSF

SEQ ID NO: 201 - protein, 444 aa, Populus trichocarpa
MICIKSSANAVGGKTARACDSCIKKRARWYCAADDAFLCQACDSSVHSANPLARRHERVRLKTASLKSLDLCSKENSVPSWHGGFTRKARTPRHGKPVSQSKIAETIRNIPIPLVPEVGSDEISHEDNEEEHLLYRVPIFDPFVADLCASTTISNEAGAIVPAGGNDGTDQRVADSNGVESKILIGAIERRDVESLPGFLPSDMDLAEFAADMESLLGRGLENESFGMEELGLMDCKEEKEFEVKGFPLWNGKVKVEDEENASVERKAVRKCYAGIETDMAKDPIFELSFDYNSSATCGEEDEKVGIEEGDLKNTRGEYEDDDGAKRKILLSLDYEAVMTAWASQGSPWTNGNRPDFDPDECWPDCMGICGAQLHHPYGDMISGLGAHPAMVDGGREARVSRYREKRRTRLFSKKIRYEVRKLNAEKRPRMKGRFVKRTTLAGK

SEQ ID NO: 202 - protein, 416 aa, Arabidopsis thaliana
MKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 203 - protein, 405 aa, Arabidopsis thaliana
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 204 - protein, 347 aa, Oryza sativa Indica Group
MELGLGRYWGVGGRRCGACAVAPAAVHCRTCDGGGGGGGYLCAGCDAEHGRAGHERVWVCEVCELAPAAVTCKADAAALCAACDSDIHDANPLARRHERVPGHPIGSSAAPPPDALLLGGENDAAAAVDGGGGGKEVKLDFLFADFMDPYLGGSPELARFPHADSVVPNHNGSAGPAMELGFAGGGGAAVKPSYSSYTAASLGNSGSSSEVGLVPDAICGGGGGGIIELDFAQSKAAYLPYASTPSHSMSSSMDMGVAAPEMSDGAAAAAGRAYAAEGRAARLMRYREKRKNRRFEKTIRYASRKAYAETRPRVKGRFAKRADDHDAAAPPPQIMLDFAGYGVVPTF

SEQ ID NO: 205 - protein, 447 aa, Oryza sativa Indica Group
MSSKAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAVGQLLSRRLVVVPEEAAGSGGDSPEERKDEGEIVEEQEQLLYRVPIFDPALSEFCSPPPLEDAAAAVSCCNEDGAVENPTKPSMTTTTATTPPLQFFPDGHANFGPTDAELREFAADMEALLGRGLDDGNDEDSFCMETLGLIEPVDDDAGRVKVEADGDAGMTLAWCHELDTETSSGEMLDIDFDYGSPQAATTPDEKVGSSGPAAAADDDAQFQQSSLALSLNYEAIIESWGTSPWTDGERPRVKLDDSWPRDYSGVWMAAAGVFGHGGEEQALTPRLGMDGGREARVSRYREKRRTRLFSKKIRYEVRKLNAEKRPRMKGRFVKRAAAAAAVATACVA

SEQ ID NO: 206 - protein, 448 aa, Oryza sativa Japonica Group
MSSTAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAFGQLLSRRLVVVPEAAAGSGGDSPEERKDEGEIVEEQEQLLYRVPIFDPALSEFCSPPPLEDAAAAVSCCNEDGAVENPTKPSMTTTTATTPPLQFFPDGQANFGPTDAELREFAADMEALLGRGLDDGNDEDSFCMETLGLIEPVDDDAGRVKVEADGDAGMTLAWCHELDTETSSGEMLDIDFDCGSPQAATTPDEKVGSSGPAAADDDAQLQQSNLALSLNYEAIIESWGTSPWTDGERPHVKLDDSWPRDYSGVWMAAAGVFGHGGEEQALTPRLGMDGGREARVSRYREKRRTRLFSKKIRYEVRKLNAEKRPRMKGRFVKRAAAAATAAVATACVA

SEQ ID NO: 207 - protein, 438 aa, Vitis vinifera
METTSKSRPSAAVPCDFCDSKTAVVHCRADSAKLCLLCDRHVHSANALSRKHLRSQICDNCRTEPVSFRCFTDNLALCQSCDWDSHGNCSVPSLHERTPVESFSGCPSPLELASVFRVDLKDGNWSSWNFGSVNVQDFVVPGENCYAGCGTKVEKNGISVVYEQLVDLIRSDVDVVRGDVDGDGDEGEDGAELGPGTPGRCANMGNFQGVDLDNGDDEELLRQQTPFTSLLMLPTPVDARDTGCGYGCAVEGDAMWDRGHLSYQAPQIWDFHLGRSRICKETSPEAGYDVDNSGFVIKNYSEITKGSSLTRTKALQGMYEMNCTTTHEDILSKNSHSNKALSSQGPTTAESNNIPIVGPSSESWTAEPNTNSIKSMQFKDLLIGSGTARTETTNVDMELLAQNRGHAIYEKHIRYESRKARADTRKRVKGRFVKASDS

SEQ ID NO: 208 - protein, 449 aa, Vitis vinifera
  misc_feature (108)..(108): Xaa can be any naturally occurring amino acid
  misc_feature (225)..(225): Xaa can be any naturally occurring amino acid
  misc_feature (275)..(275): Xaa can be any naturally occurring amino acid
  misc_feature (288)..(288): Xaa can be any naturally occurring amino acid
MLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPXLPIAGCLYGPPATDPGGTVVRSAAEADNGFLGQEAEETIDEEDEDEAASWLLLNPVKNNNGSSNNQNNGLLFGGEVDEYLDLVEYNSCPENQFSDQYNQQQPPPHYSVPHKNYGGDXVVPVQCGEAKGQLHQQHQQQGFHLGMEYESSKAAYSYNPSISHSVSFFIXVNCLISLILHDHXAYAFQTHTGLSESSVSSFILVYGGCLQFIQIHPKFIRSHVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 209 - protein, 475 aa, Vitis vinifera
  misc_feature (37)..(37): Xaa can be any naturally occurring amino acid
  misc_feature (51)..(51): Xaa can be any naturally occurring amino acid
MHDGNEFKLKEEHLDASSTANALTGGEWLRGVEGETXMKATIEHANKVYKXVRGIIGNVETKQQMDLTQAKVANAMGGKTARACDNCLHKRARWYCGADDAFLCQACDASVHSANQLAERHERVRLQAASCKNADSMRDNSTPAWHQGFTRKARSPRNVKRTSVQPSKHENKFPTPPPLVPEIGSEEASPDENEEQFLFRVPTFDPFVAELNNDGIREIGMENDSKPLSDYGHEEIGDLDSLTGFLPSEMDLAEFAADVESYLGAGLDEDSCGIKGIGVLDCEQGDMDACFGDQKVKVKEERVETDATFHLDPELDMTKELLAWNLDYESTVMDEEEHEEKMVAAVEMRRKISLSLNYEDVITAWASQGSPWTTGNRPEFDPNDYWPDYMGACPTNVHGPCGDVGGVGGNFGGRDGGREARVLRYREKRRTRLFSKKIRYEVRKLNAEKRPRMKGRFVKRASFAAGPCFPILNVK

SEQ ID NO: 210 - protein, 392 aa, Arabidopsis thaliana
MVVDVESRTASVTGEKMAARGCDACMKRSRASWYCPADDAFLCQSCDASIHSANHLAKRHERVRLQSSSPTETADKTTSVWYEGFRRKARTPRSKSCAFEKLLQIESNDPLVPELGGDEDDGFFSFSSVEETEESLNCCVPVFDPFSDMLIDDINGFCLVPDEVNNTTTNGELGEVEKAIMDDEGFMGFVPLDMDLEDLTMDVESLLEEEQLCLGFKEPNDVGVIKEENKVGFEINCKDLKRVKDEDEEEEEAKCENGGSKDSDREASNDKDRKTSLFLRLDYGAVISAWDNHGSPWKTGIKPECMLGGNTCLPHVVGGYEKLMSSDGSVTRQQGRDGGGSDGEREARVLRYKEKRRTRLFSKKIRYEVRKLNAEQRPRIKGRFVKRTSLLT

SEQ ID NO: 211 - protein, 332 aa, Arabidopsis thaliana
MEAEEGHQRDRLCDYCDSSVALVYCKADSAKLCLACDKQVHVANQLFAKHFRSLLCDSCNESPSSLFCETERSVLCQNCDWQHHTASSSLHSRRPFEGFTGCPSVPELLAIVGLDDLTLDSGLLWESPEIVSLNDLIVSGGSGTHNFRATDVPPLPKNRHATCGKYKDEMIRQLRGLSRSEPGCLKFETPDAEIDAGFQFLAPDLFSTCELESGLKWFDQQDHEDFPYCSLLKNLSESDEKPENVDRESSVMVPVSGCLNRCEEETVMVPVITSTRSMTHEINSLERNSALSRYKEKKKSRRYEKHIRYESRKVRAESRTRIRGRFAKAADP

SEQ ID NO: 212 - protein, 372 aa, Arabidopsis thaliana
MGYMCDFCGEQRSMVYCRSDAACLCLSCDRSVHSANALSKRHSRTLVCERCNAQPATVRCVEERVSLCQNCDWSGHNNSNNNNSSSSSTSPQQHKRQTISCYSGCPSSSELASIWSFCLDLAGQSICEQELGMMNIDDDGPTDKKTCNEDKKDVLVGSSSIPETSSVPQGKSSSAKDVGMCEDDFYGNLGMDEVDMALENYEELFGTAFNPSEELFGHGGIDSLFHKHQTAPEGGNSVQPAGSNDSFMSSKTEPIICFASKPAHSNISFSGVTGESSAGDFQECGASSSIQLSGEPPWYPPTLQDNNACSHSVTRNNAVMRYKEKKKARKFDKRVRYASRKARADVRRRVKGRFVKAGEAYDYDPLTPTRSY

SEQ ID NO: 213 - protein, 347 aa, Arabidopsis thaliana
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 214 - protein, 373 aa, Arabidopsis thaliana
MGYMCDFCGEQRSMVYCRSDAACLCLSCDRNVHSANALSKRHSRTLVCERCNAQPASVRCSDERVSLCQNCDWSGHDGKNSTTTSHHKRQTINCYSGCPSSAELSSIWSFCMDLNISSAEESACEQGMGLMTIDEDGTGEKSGVQKINVEQPETSSAAQGMDHSSVPENSSMAKELGVCEDDFNGNLISDEVDLALENYEELFGSAFNSSRYLFEHGGIGSLFEKDEAHEGSMQQPALSNNASADSFMTCRTEPIICYSSKPAHSNISFSGITGESNAGDFQDCGASSMKQLSREPQPWCHPTAQDIIASSHATTRNNAVMRYKEKKKARKFDKRVRYVSRKERADVRRRVKGRFVKSGEAYDYDPMSPTRSY

SEQ ID NO: 215 - protein, 373 aa, Arabidopsis thaliana
MLKQESNDIGSGENNRARPCDTCRSNACTVYCHADSAYLCMSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 216 - protein, 355 aa, Arabidopsis thaliana
MLKVESNWAQACDTCRSAACTVYCRADSAYLCSSCDAQVHAANRLASRHERVRVCQSCERAPAAFFCKADAASLCTTCDSEIHSANPLARRHQRVPILPISEYSYSSTATNHSCETTVTDPENRLVLGQEEEDEDEAEAASWLLPNSGKNSGNNNGFSIGDEFLNLVDYSSSDKQFTDQSNQYQLDCNVPQRSYGEDGVVPLQIEVSKGMYQEQQNFQLSINCGSWGALRSSNGSLSHMVNVSSMDLGVVPESTTSDATVSNPRSPKAVTDQPPYPPAQMLSPRDREARVLRYREKKKMRKFEKTIRYASRKAYAEKRPRIKGRFAKKKDVDEEANQAFSTMITFDTGYGIVPSF

SEQ ID NO: 217 - protein, 397 aa, Zea mays
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEATATAASVAGDKDEEVDSWLLLTKDPDDDDKNHNCSSNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISYSSSMEVGIVPDNMATTDMPSSGILLTPAGAISLFSSGPPLQMPLHLASMDREARVLRYREKKKSRKFEKTIRYATRKTYAEARPRIKGRFAKRSSDMDDEVDQMFSAAALSSDGSYGTVPWF

SEQ ID NO: 218 - protein, 398 aa, Zea mays
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 219 - protein, 410 aa, Chlamydomonas reinhardtii
MSSCVVCAAAAVVWCQNDKALLCKDCDVRIHTSNAVAARHTRFVPCQGCNKAGAALYCKCDAAHMCEACHSSNPLAATHETEPVAPLPSVEQGAAPEPQVLNMPCESVAQSAASPAAWFVDDEKMGTTSFFDAPAVLSPSGSEAVVPVMSAPIEDEFAFAAAPATFKEIKDKLEFEALDLDNNWLDMGFDFTDILSDGPSDVGLVPTFDAVDEAADAVADAIVPTFEEEQPQLQQQEPLVLAPAPEESAASRKRAAAEEAAEEPAAKVPALTHQALLQAQAAAFQAVPQASALFFQPQMLAALPHLPLLQQPMMPAAVAPAPVPKSGSAAASAALAAGANLTREQRVARYREKRKNRSFAKTIRYASRKAYAEIRPRIKGRFAKKEEIEAWKAAHGGDDAIVPEVLDAEC

SEQ ID NO: 220 - protein, 538 aa, Physcomitrella patens subsp. patens
MATKVASRSMTTAIAIAGRASRACDVCANKSARWYCGADTAYLCDRCDTQVHSANALAKRHERVRLTVSGVPMKSSRKVTVTMADHDEDSEMPRKQSSLKKCHSAPVQVMSSRKRSRTSRPHPLKRRASEAKPTSKVSKVEDVKVKEELLTFSDIFDTEDFLVDDTQEVPAFITVAQDSSPSSSEFDLSSPELSPEFRSDFYGVCSPSEDSFAAYFKGKAAHNDFSDDVMADQFVVPDGVFDNCLDSGVNICCDVDSSISIAGDACFIPGDIPGLDGYEDDYSLCFHLALRDASPDSFGEDSAATATATGRSLEDSPSRVLLCTCFYYFTPSILNNVLKCRKQMYRPECANADAIPVISYLAVVHPTNNAVSVEADQFGNGPFAKFFAKKPKGEKVLLSPENIKSEAKEILRCSLEGLSEEDLRTAPTLRLNYEDVLTAWSDRGEPWVNPENSTVVPDMGEGGADDDQTGGGREARVLRYKEKRRSRLFSKTIRYEVRKLNAERRPRMKTCGGSDGGGGLRQAATVAAAKSLSILKLS

SEQ ID NO: 221 - protein, 574 aa, Physcomitrella patens subsp. patens
MARPKSTAHTNMATAMAIAGRASRACDGCGSQGARWYCEADNAYLCSRCDRSVHSANALASRHERVRLNPHGTVSQVPKKALVDTSGADGNDAHKPHHPRSTHTHFLPSRKRSRLCQRPNPHLQHAADISNPEHRRGKMKTESRNPGESHEVPNFITINIQESPLSFAHDSATGISMAEFCKGRATATAAMYVGVEDAYEELSSGDSGPDFLVPNGYTEDFDSAIGAPTEYHQNAGSPLDSGNGDEDSDNSHEMACVGDGLQLCGSDERYEGYPLEFSDIVGLGNGDAFEEDCENTSGFVDECCEVNGGGLGNGMECSLQAKMSLEQQKGFSFSKDFYYEVNQECIVPDSYDLIRKEVADVLRCSLEGEPMKHTPSLLQLNYEDVLSAWSDRCLWTDGKCPQKLPDDSYSEIAGDVGLVPDLSNGCQAVPGGGGDGGREARVMRYKEKRRTRLFSKKIRYEVRKLNAECRPRMKKPNCAYSLQHPNAAMSQSFRNENNVFLWYLVETGPIREEDTWVLVIRTKAHTSQHGSITVTTYSVWLGGRKSSSGTCDGSADESWFLRGDHANPHLVDIF

SEQ ID NO: 222 - protein, 495 aa, Physcomitrella patens subsp. patens
MTTRTACKSIVTAMAIAGQASRACDVCMNKSARWYCGADRAYLCEKCDIQVHSANALAQRHERVPLTPNAESTILARKDSPDTKNAKEILLRKPTMSKKLQAPPVNVLPSRKRFRTCRLHPFRQAKHSPGAKHAPNQLEEGDAKMKEDLLMFSETFETENFLVDVTQKVPSLIVVMQDSSPSSSELDVCSDFFQELRSDSQEVRSSPWSDSLAAFFKGKAAQEDCFPDDDTSDQFFLPDAFDDGINICCDMDGNISVAGDACFISNDIPGLSGFEDFGSREFVGDSLSFDFAFHDTLPRAFEGVGADTSEMGGISSKYNLVGAENDQFRTGPFVKFFSKIPRNEKKMHLTPENIKKEAKEILLCCREGLSEVNLGLAPTLRLNYEDVITAWSDRGEPWFYPHDCTSDATDAGLVPDMAQEGADDCQGSREASVMRFKEKRRSRLFSKRIRYEVRKLNAEKRPRMKGRFVKKNSSGFDFRLDPFLSSETHVLAHPH

SEQ ID NO: 223 - protein, 364 aa, Physcomitrella patens subsp. patens
MPKSCDACHISSAVVYCRADAAYLCAGCDGKVHGANKLASRHERVWMCEVCEVAVAVVTCKADAASLCVSCDTDIHSANPLAQRHERVPVQPLFDCASSAREAHISVPFPESECHETLKGVEDSCVAEAGSWLLPHPKIPTNAIIRGSAAADEAPDSPFRARPFSPKLKKQKVDLAADIFSDVDPFLELDDATVTGIQPDSLVPVHIPEGSEDSPSLAHSMEPSFTTDFHLSEKSGYSFGTSTLTHSISCSSVDAAVVPDSSLSDISTPYPLDSQGAQELSGTRMPQQVSGPIDTVDREARVMRYKEKRQKRKFEKTIRYASRKAYAESRPRIKGRFAKRTDSDVEQLFSSCSMDSSFGVVPSF

SEQ ID NO: 224 - protein, 495 aa, Physcomitrella patens subsp. patens
MPGGGVKDAATNSVATAMAIAGRASRACDVCGSQRARWYCNADNAYLCYRCDQNVHSANALALRHERVRLNSQGNISSQSPRKALVVDTSARKHSRNHTAHAAQSPPSRKRSRLSRRPNPHVSSPVDTLFKPHKASHRGSKVKSESSHEVPNFVTVNIQESSFSFTHDSATVMSMAEYCKGRAAAAAAAAMSMSVDVDTYEELSSGDSDQFLVPTGYLDDFESAAVAPVEDGSSPSEDAEDAPGYEENHHDITDAVDLRDGLELEGGSDDAYRLDFSDIVALREGDEDAFEGDYGETEGDAFEGECGDTEGDGEVEAAASNEQSCVDGFPEEQPNCVVPFTKEYLYKVKSENSVRDGFALIKKEVAAVLRCSLEGEEAKPAAPSLLRLNFDDVLSAWSDRSLWTDGKRPQTVPDDSSEAVGGLDLGLVPDLSKGCAQGQPGTGGDRGREARVLRYREKRRTRLFSKKIRYEVRKLNAERRPRMKGRFVKRTTGCS

SEQ ID NO: 225 - protein, 646 aa, Physcomitrella patens subsp. patens
MAGVKGAAHANVAMAMAIAGRASRACDVCGSQRARWYCEADNAHLCNRCDQSVHSANALALRHERVRLNPQDCTTQPLKKVVVDTLDASNKSRKSHHPRPTDKHSLPSRKRSRLSRRPNPHLRPPTSTSKSQHRRGKVKSEGRGAEDSHEVPNFITVNIQESPVSFAHDSATAMSMAEFCKERATAAASVYVDVEDAYEEISSGDTGPDFLVPNGYMDDFESAIGAPIGCHEDARSPFDSGNGAMDMNKSHDIMFMRNDLELCGSDEQYEDYPLDFSDIVGLRDGDAFEGDCGDTSELVDEVGEENKDEDGDGDGDGDGDGFECSLDARAQSNVCEDQGLVSYTQDFPYKVKQEYTVPDSYDLIKKEVAAVLRCSLQGEEVKPAPSLLRLNYEDIMSAWSDRSLWTDGKRPQTVPDDSNSESTVDLGMVPDFGNGCQTVPGGSDGGRGARIMRYREKRRTRLFSKKIRYEVRKLNAERRPRMKSQLRYDLALSWVWHYRMTVLTDRNKESMMSKASWKYVPVRSLVRMCDRLVPRELSILWPLILQPGIHHLDRLEQQYQKSGSTGGLDWLRMALRLEHLNSVMGCLSFQSLLPLSVVQTRFQRVTTKRSDSVGEELFNDTPSSVIYSLTEGLIVMRTGILCNCTL

SEQ ID NO: 226 - protein, 475 aa, Physcomitrella patens subsp. patens
MAGGGGIKGAVNNNVATAMAIAGRDSRACDVCGLHRARWYCSVDNAHLCRRCDQNVHSANALALHHERVRLDLQGNALHTPRKALKGNTSAPQNSLKSAAQMDHAAPSRKSFRQSRRPNTDASPPNSHKINRRGKEKSDSSHEVPNFVTVNIHESPFSFTHDSATAMSIAEYCKGRAAAAAAMAADVDTNEELSSGDSDQYLVPNGYLDDFESATVPTPGCRQQGCDPSDDAASNDALDDGEGKDQYDSGAFDQTNGLEFKRGSDQDRINEKYRLGFSEVVGMRDADDFEGESGYTEGEGEVEDEAYDQSCAYGDPERQRVSPFVKDLKSEYDVLDRLDLIKREVAAVLRCSLEAQEKKSAPPPLLRLNFDDVLSAWSDRSLWTDGRRPQTVPDDSSEAVGGTDVGLVPDINTQYAQGATLAAGDKGREFRVMRYKEKRRTRLFSKKIRYEVRKLNAERRPRMKGRFVKQTPGGS

SEQ ID NO: 227 - protein, 368 aa, Physcomitrella patens subsp. patens
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSMVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRYKEKRQKRKFEKTIRYASRKAYAESRPRIKGRFTKRTDSDVEQMFSSCTADSGFGVVPSSC

SEQ ID NO: 228 - protein, 313 aa, Arabidopsis thaliana
MISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 229 - protein, 406 aa, Arabidopsis thaliana
MMKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 230 - protein, 367 aa, Beta vulgaris subsp. vulgaris
MMKEEVSGSDTNSWARVCDTCRAAPCTVYCRADSAFLCTSCDARIHAANQVASRHERVWVCEACERAPAAFLCKADAASLCATCDAEIHSANPLARRHQRVPIMPVAGCVYGPQGGRMSEDRFLTLPEGDDHTTDHEGDEDEAASWLLLNPVKNSNNQNTNGFLTGGGEVDEYLDLLEYNSGADNQLCEQYNQQQEFKVPEKNCGGDSVVPVQCREAKDHQIQYQNFLFGMECETKSGYTYNTSISQSVSVSSMDVGVVPESAMSDISMSHPRPPKGTIDLFSSPPMQVPTQLSPLDREARVMRYREKKKNRKFEKTIRYASRKAYAETRPRIKGRFAKRTDVEAEMDQMFTNSLMADSGYGIVPSY

SEQ ID NO: 231 - protein, 386 aa, Solanum lycopersicum
MGIFREAPNCFPGGWNIGAAARMAKSCEYCHLAAALVFCRTDNTFVCLSCDTRLHARHERVWVCEVCEQAAASVTCRADAAALCVACDRDIHSANPLARRHERVPVVPFYDPVESVVKSTAATLLVSINGTTTTATTTATITPELGKVDTCIGHHENNNDPWIPPNTITSKLPLNTEMKGMDFIFTDSENFLDFDYPACVDTQSQPHYNSSNDSVVPVQANTPIKSLPFHHQEKHFEIDFTQSHIKSYNTPSLSVSSSSLDVGIVPDGSSISEISYPYIRTMNNSNSSIDLSNSANHQGEKLLGLDREARVLRYREKKKNRKFEKTIRYASRKAYAETRPRIKGRFAKRTDGSAGAGEFDDVDGIFSGTDFIAAESRYGVVPSFLT

SEQ ID NO: 232 - protein, 395 aa, Zea mays
MDYNFDTSVLDEDVAGRGGREGSCPPAWARACDGCRAAPSVVYCHADTAYLCASCNSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 233 - protein, 444 aa, Picea abies
MVKEEDKDWHTVEDLHRGSHVDHKEFLRGIGGWRMSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 234 - protein, 339 aa, Brassica nigra
MLKQESNYNISNRENNRGPRACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSHNHNNNNQNNELLFSDDYLDLADYNSSMDYKFAGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 235 - protein, 339 aa, Brassica nigra
MLKQESNYNISNRENNRGPRACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSHNHNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 236 - protein, 339 aa, Brassica nigra
MLKQESNYNISNRENNRGPRACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSHNHNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFENTIRYASRKAYAERRPRINGRF

SEQ ID NO: 237 - protein, 339 aa, Brassica nigra
MLKQEINYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSHNHNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 238 - protein, 343 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 239 - protein, 343 aa, Brassica nigra
MLKQESNYNISNRENNRGARACDTCRSTICTVYCHADSAYLCNSCDAEVHSANRVASHHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 240 - protein, 344 aa, Brassica nigra
MLKQESNYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSPNHNNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 241 - protein, 345 aa, Brassica nigra
MLKQESNYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSPNHNNNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 242 - protein, 345 aa, Brassica nigra
MLKQESNYNISNRENNRGPRACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNNNQNNELLFSDDYLDLADYNSSIDYKFTGQYNQPQHKQDCTVPQTNYGGDRVVPLQLEETRGNVRHKKEKITYGSSGSQYNYNDSINHDAYNPSMETDFVPEPTARETTVSHQKTPKIHQLPEPLVQILSPMDREARVLRYREKKKRRKFEKTIRYASRKAYAERRPRINGRF

SEQ ID NO: 243 - protein, 345 aa, Brassica nigra
MLKQESNYNISNRENNRGPRACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNNNQNNELLFSDDYLDLADYNSSIDYKFTGQYNQPQHKQDCTVPQTNYGGDRVVPLQLEETRGNVRHKKEKITYGSSGSQYNYNDSINHDAYNPSMETDFVPEPTARETTVSHQKMPKIHQLPEPLVQILSPMDREARVLRYREKKNRRKFEKTIRYASRKAYAERRPRINGRF

SEQ ID NO: 244 - protein, 345 aa, Brassica nigra
MLKQESNYNISNRENNRGPRACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNNNNQNNELLFSDDYLDLADYNSSIDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 245 - protein, 343 aa, Brassica nigra
MLKQESNYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSPNHNNNNNNNNQNNELLFSDDYLDLADYNSSMDYKFTGQYNQPQHKQDCTVPQTNYGGDRVVPLQLEETGGNVRHKKEKITYGSSGSQYNYNDSINHDAYNPSMETDFVPEPTARETTVSHQKTPKIHQLPEPLVQILSPMDREARVLRYREKKKRRKFEKTIRYASRKAYAERRPRINGRF

SEQ ID NO: 246 - protein, 342 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTAVTEPEKRAVLVQDDEEGKEDAKETASWMFPYSDKGSPNHNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRRAYAERRPRINGRF

SEQ ID NO: 247 - protein, 347 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTTVTEPEKRAVIVQDDEEGKEDAKETASWMFPYSDKGSHNHHNNNNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 248 - protein, 343 aa, Brassica nigra
MLKQESNYNISNRENNRGARACDTCRSTICTVYCHADSAYLCNSCDAEVHSANRVASRHKRVPVCESCERAPAAFMCEADDVSLCTTCDSEVHSANPLARRHQRVPVVPITGNSCSSLATTHHTAVTEPEKRAVLVQDDEEGKEDAKETASWMFPYSDKGSPNHNNNNNNNNNQNNELLFSDDYLDLADYNSSMDYKFTGQYNQPQHKQDCTVPQTNYGGDRVVPLQLEETGNVRHKKEKITYGSSGSQYNYNDSINRNAYNPSMETDFVPEPTARETTVSHQKTPKIHQLPEPLVQILSPMDREARVLRYREKKKRRKFEKTIRYASRKAYAERRPRINGRF

SEQ ID NO: 249 - protein, 344 aa, Brassica nigra
MLKQESNYNISNRENNRGARACDTCRSTICTVYCHADSAYLCNSCDAEVHSANRVASRHKRVPVCESCERAPAAFMCEADDVSLCTACDSEVHSANPLARRHQRVPVVPITGNSCSSLATTHHTTVTEPEKRAVIVQDDEEGKEDAKETASWMFPYSDKGSHNHHNNNNNNNNQNNELLFSDDYLDLADYNSSMDYKFTGQYNQPQHKQDCTVPQTNYGGDRVVPLQLEETRGNVRHKKEKITYGSSGSQYNYNDSINHNAYNPSMETDFVPEPTARETTVSHQKTPKIHQLPEPLVQILSPMDREARVLRYREKKKRRKFEKTIRYASRKAYAERRPRINGRF

SEQ ID NO: 250 - protein, 343 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNSENNRFSVGEEYLDLVDYSSSMDKRFTGQANQYQQDYNVPQRSYVADGVVPLQVGVSKGHMHHEQHNFQFGFTNVSSEAHQISNGSPIHMVSLVPESVTSDATVSHQRSPKSGTEELPEAPVQMLSPMERKARVLRYREKKKTRKFEKRIRYASRKEYAEKRPRIKGRFAKRNEVDADQAFPTVVMFDTGYG

SEQ ID NO: 251 - protein, 336 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYG

SEQ ID NO: 252 - protein, 340 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTG

SEQ ID NO: 253 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYG

SEQ ID NO: 254 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYG

SEQ ID NO: 255 - protein, 335 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETAEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 256 - protein, 338 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 257 - protein, 339 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 258 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEAHQISNGSPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 259 - protein, 335 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETAEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 260 - protein, 338 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDHNNNNNSENNRFSVGEEYLDLVDYSSSMDKRFTGQSNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 261 - protein, 339 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 262 - protein, 339 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVRMLSPMERKARVLRYREKKKTRKFEKRIRYASRKEYAEKRPRIKGRFAKRNEVDADHALSTMVVFDTGYG

SEQ ID NO: 263 - protein, 336 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 264 - protein, 338 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 265 - protein, 338 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPETVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 266 - protein, 417 aa, Arabidopsis thaliana
MMKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLLSEQFLNDVVEPKIEFPMIRSGLMIEEEEDNAESCLNGFFPTDMELEEFAADVETLLGRGLDTESYAMEELELSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 267 - protein, 406 aa, Zea mays
MVPLCGFCGKQRSMIYCRSDAASLCLSCDRSVHSANALSRRHRRTLLCDRCGLQPASVRCLEDNTSLCQNCDWNGHDAASGASGHKRQAINCYSGCPSSAELSRIWSFIIDIPTVAAEPNCEDGLSMMTIDDSDVTNHHGASDDKRLLEIANTALMSDPPSPDKLKPLIGSSSGDGFDVLPLATDQPAGPVSATPKVPYARDDNKFNDGMYEDLCVDDADLTFENYEELFGTSHIRIEELFDDAGIDSYFEMKETPPFDFNEQPKIVQLQCSDVVPADCAMSNTGERADSSLCIPVRQVRSSISHPLSGLTGESSAGDHQDCGVSPILLMGEPPWYSPGPEGSLAGGSRDSALTRYKEKKKKRMFDKKIRYASRKARADVRKRVKGRFIKAGEAYDYDPLSQTRSY

SEQ ID NO: 268 - protein, 405 aa, Arabidopsis thaliana
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNADKRPRMKGRFVKRSSIGVAH

SEQ ID NO: 269 - protein, 373 aa, Chrysanthemum x morifolium
MLKQESNDIGSGENNRARPCDTCRSNACTVYCHADSAYLCTSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 270 - protein, 408 aa, Oryza sativa Japonica Group
MGALCDFCGEQRSMVYCRSDAASLCLSCDRNVHSANALSRRHTRTLLCDRCASQPAMVRCLVENASLCQNCDWNGHSAGSSAAGHKRQTINCYSGCPSSSELSKIWTFVSDIPNVAPEPNCEQGISMMSISDSGVSNQDNAAGDSSLLDIASATLMSDLGTAGKPKSLIGSSSEAGVNLLPLATDQMAGSVDSTSAKVPYTADQDMFSKDSIYEDFCVDDVDLSFENYEELFGTSHIQTEQLFDDAGIDSYFESKEIPSGNSDEQPKLMQPVTSNAVSADSGMSIPGAKGDSSLCIPVRQARSSISLSFSGLTGESSAGDYQDCGVSPVLLMGEPPWHPPGPEGSFAGATRDDAITRYKEKKKRRKFDKKIRYASRKARADVRKRVKGRFVKAGEAYDYDPLCETRSY

SEQ ID NO: 271 - protein, 368 aa, Hordeum vulgare subsp. vulgare
MNCNFNSDLLEKEAGRTSFPWARPCDGCHAAPSAVYCCADAAYLCSSCDTQVHSANRVASRHERVRVCETCESTPAVLACHADAAALCTACDAQVHSANPIAQRHQRVPVLPLPAVAIPAASGFAEAEASVTAHGDKEGGEEVDSWLLRRNSDDNNCANKIDRYFNLVGYNMYYDNITCDPRPQEQYRMQEQQHVQNRYREKEGCECVVPPQVVMASEQQGSNYGTIGAGQAASVTAMASTYTASISNDISFSSMEVGIVPDNTRPNISNRNILTSSEAIELSGHSLQMPVHFSSMDREARVLRYKEKKQARKFQKTIRYATRKAYAEARPRIKGRFAKRSDIEHEENHMLSPPALPDTSSYNTVPWF

SEQ ID NO: 272 - protein, 329 aa, Hordeum vulgare subsp. vulgare
MIKAEPDLRGQLRGSAGVGGMQLQQRCDSCRSAPCAFYCRADSAALCAACDADVHSANTLASRHRRVPMGAVAPASPAGGAFVVRPGGVNSSWPIREGRRSYYDDREGEEEEATSWLLLDPLRGSEADAPAFGDALVADFLDLGRAGEKEASSKDYHGHGMESNEGSHDHELVVPGEPVAQLHERQGFTAEMAYDAQNSNHGYGFGATFERSLSMSSSPDNSSTVQDVSSSYMRRSESSVDLFSTAAHTSPQFMGMAMDREARVHRYREKRKMRRFEKTIRYASRKAYAETRPRIKGRFAKRADADLEVDQYFSAAALSDSSCGVVPTF

SEQ ID NO: 273 - protein, 329 aa, Hordeum vulgare subsp. vulgare
MIKAEPDLRGQLRGSAGVGGMQLQQRCDSCRSAPCAFYCRADSAALCAACDADVHSANTLASRHRRVPMGAVAPASPAGGAFVVRPGGVNSSWPIREGRRSYYDDREGEEEEATSWLLLDPLRGSEADAPAFGDALVADFLDLGRAGQKEASSKDYHGHGMESNEGSHDHELVVPGEPVAQLHERQGFTAEMAYDAQNSNHGYGFGATFERSLSMSSSPDNSSTVQDVSSSYMRRSESSVDLFSTAAHTSPQFMGMAMDREARVHRYREKRKMRRFEKTIRYASRKAYAETRPRIKGRFAKRADADLEVDQYFSAAALSDSSCGVVPTF

SEQ ID NO: 274 - protein, 441 aa, Oryza sativa Indica Group
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNKDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRRMQRHDPGSRAVSPRDQMCRSKWTRCSPLQLYLTVAMVLFHGSDGTHETLSYRHIYGDLLSSNNIDPVGVVLDNLCYE

SEQ ID NO: 275 - protein, 380 aa, Olea europaea
MLKEKSRGVHGGNTSSHWARICDTCQSAVCTMYCRADSAYLCTGCDSRIHRTSPEASRHQRMWVCEACERAPAAFLCKADAASLCITCDSDIHSAQPLARRHQRVPILPIPGMLCGTPSAPYPSGLVMGPTGVAAKIEFLTQDEDQTIHEEEDEDEAASWPLFNHVKNICNQSNNIGRFFGGEVDEYLDLDEYNSYQDNQFSNQDNNQLQPYDVSQKSYGSDNVVPIQYGKSKDQIHNHGFQLGREYEASKNVYDNPASISHTVSFSSLDVGVVPESTTSEVSVPHPRPPKGTIDLFSSPPIPMPTQLSPMDREARVLRYREKKKARKFEKTIRYASRKAYAETRPRIKGRFAKRTDVRANQMFSSTLIEEGGYGIVPSF

SEQ ID NO: 276 - protein, 372 aa, Sinapis alba
MLKPESYNISNRENNRGARACDTCQLTICTVYCHADSAYLCTSCDAQVHSANRVASRHKRVRVCESCERAPAAFMCEADDVSLCTACDSEVHSANPLARRHQRVPVVPITGNSCSSLATHHTTVTEPEKRAVLVQDDQEGKEDAKETASWMFPYSDKSNHNHNNNNNNQNNELLFSDGYLDLADYNSSMDYKFTGQYNQHQNKQDCTVPQTNYGGDRVVPLQLEETKGNLRHKEHNITYGSSGSQYNYNGSINHNAYNPSVETDYVPEPTARDTTVSHQKTPKGAIHKQPEPLIQILSPMDREARVLRYREKKKRRKFEKTIRYASRKAYAERRPRINGRFAKMSETEAEDQDFNTMLMYYDTGYGIVPSFY

SEQ ID NO: 277 - protein, 330 aa, Arabidopsis thaliana
MEARCDFCGTEKALIYCKSDSAKLCLNCDVNVHSANPLSQRHTRSLLCEKCSLQPTAVHCMNENVSLCQGCQWTASNCTGLGHRLQSLNPYSDCPSPSDFGKIWSSTLEPSVTSLVSPFSDTLLQELDDWNGSSTSVVTQTQNLKDYSSFFPMESNLPKVIEEECSGLDLCEGINLDDAPLNFNASNDIIGCSSLDNTKCYEYEDSFKEENNIGLPSLLLPTLSGNVVPNMSLSMSNLTGESNATDYQDCGISPGFLIGDSPWESNVEVSFNPKLRDEAKKRYKQKKSKRMFGKQIRYASRKARADTRKRVKGRFVKSGETFEYDPSLVM

SEQ ID NO: 278 - protein, 444 aa, Populus trichocarpa
MVTHKSKTKETVPCDFCSEQTAVLYCRADSAKLCLFCDQHVHSANLLSRKHVRSQICDNCSTEPVSFRCSTDNLVLCQECDWDAHGSCSVSASHDRTTIEGFSGCPSALDLASIWGFDLEEKKPEPLIENWSNNSCGVIHDLVNEPWVYDKSSGNLTFQDLMVPNENNNNGNRNIDNSPSCGKYKHVICKQLFELFKRDLIGGGVEGEGCGFGDGEGCGFGGGDGGGETLVTQSRSGWRSGVKGVQFGNGNDGERISCVFNNDSGLLLLQVWDFHLGQLRNHDESGQLEIEYVANDAGFVIKDFGELMKETSSTSPKMLGDMYQMNCSTAHDDMTQGPATSESNNLPIVRSGFSKPRCSSSSNDVQFMEQSILIRGEGLKMEAATKVDMELLARNRGDAMQRYKEKKKNRRYDKHIRYESRKARADTRKRVKGRFVKTTEAPDS

SEQ ID NO: 279 - protein, 447 aa, Populus trichocarpa
MICNKSLANAVGGRTARACDSCIKKRASWYCAADDAFLCQACDSSVHSANLLARRHERVRLKSASLKSSDAGSKENSMPSWHGGFTRKARTPRHGKPVSRSKIEETTRNIPIPLVPEVGSDEISLEDNEEEHLLYRVPIFDPFAAELCTSTTVSNEAGAVVPAGGTDTDQRAADSSGTESKVLLGGSEGKDVESLHGFLPSDMDLAEFAADMESLLGRGLENESFGMEELGLMDCKEENELGVKGYPLGNGKVKVEEEEDAGMEEKAVRECHADIEIDIAKDPPFELSFDYDSPATCVEEDEKVGIEEGDLKNSDGEYEDDGGAKKKRRTLLSLDYEAVMTAWASQGSPWTNGYRPDFDADECWPDADCMGICGAQLHHPYGDVSGLGAHPAALVDGGREARVSRYREKRRTRLFSKKIRYEVRKLNAEKRPRMKGRFVKRTTFAGK

SEQ ID NO: 280 - protein, 393 aa, Populus trichocarpa
MISGRKAANAMGGKTARACDSCLRKRARWFCVADDAFLCQACDASVHSANQLASRHQRVRLETASSYRISSSLNTDQDYSPPAWHQGFTRKARTPRHNSNKSLLVQQLLKDDREKVLNPLPLVPEIGSEEEPNMAPDENEDDQLLCRVPVFDPFAAKMCDIVTSEDENMVVEVYGQEGACGLDNLPGFLPSDMDLAEFAADLLDCSKGEDEGQFCFADKVVKMKDEQEMETIIDCHFDQDFNMARESLLDEEVEEKKVPVPETEMMNSTGYKEMKRNVSLRLDYESVIIAWANQGCPWTTGSRPELNPDDSWTDSMGACPKDVNNPYGGLGSHTRGGDGEREARVMRYKEKRRTRLFSKKIRYEVRKLNAEKRPRMKGRFVKRTSLMGTTDFP

SEQ ID NO: 281 - protein, 379 aa, Populus trichocarpa
MGYVCDFCGEQRSMVYCRSDAASLCLSCDRNVHSANALSKRHSRTLLCERCNSQPALVRCAEERISLCQNCDWIGHGTSTSASTHRRQTINSYSGCPSASELSSIWSFVLDFPSRGESTCEQELGLMSIAENSTTDSWGPTENTIGQNASGVVEVNDRREIAKSGVWLGSSSIPESSSVPNNLDQTTRSANTSLPKDFNMDEMDLSLENYEELFGVTLNNSEELLENGGIDSLFGTKDMSVVNAVQPASSNAASADSMMSNKTEPILCFTEKQGHSSLSFSGLNVESSAADYQDCGASSMLLMGEPPWCPPCPESPFSSANRSDAVMRYKEKKKTRMFEKKVRYASRKARADVRRRVKGRFVKAGEAYDYDPLSQTRSF

SEQ ID NO: 282 - protein, 432 aa, Vitis vinifera
MISEKNVANAVGGKTARACDSCIRKRARFYCAADDAFLCQACDMSVHSANPLARRHERVRLKTASLKLPGADSLENSMPSWHQGFTRKARTPRHGKPAAHPAFKSDELTRNPLPFVPEIGADETSYDDNEEQLLYRVPIFDPFVAELCASTNSNEAVTTVANDTETADVTGSETKALVAGRGHDVDSLHGFLPSDMDLAEFAADVESLLGKGLDNESFGMEGLGLIDCKEKESVEYSLHSGRVKLEEEEDIGGVMACQADAEIDMTREPFELNFDYGSPATCEEEEEKVAVGAMDMNNKVDDPKKKNKILLRLDYEAIITAWASQGSPWTNGHRPELDPDDCWPDCLGTCGIQVHHPYGEFGGMGEQQAAMGDGGREARVSRYREKRRTRLFSKKIRYEVRKLNAEKRPRMKGRFVKRASFGGPAAFPLLNK

SEQ ID NO: 283 - protein, 474 aa, Vitis vinifera
MVSPKPSNGERVPCDFCSGQIAVLYCRADSAKLCLFCDQHVHSANALSRKHLRSQICDNCSSEPVSVRCSTDNMVLCQECDWDAHGSCSVSAAHDRKPVEGFSGCPSAVQLSSIWGLDIEEKKAPLPPPPSMAVDSWVYKSNTLTFQDLMVPNGNAVAFPDALGGEVSKRQSPSCGKHKQVIFKQLVELFRRDLLAGNGGGGGIVGDDEDDGGGGVCGGGENLVTGWQGHVGESIGIENGGVLDVDHQALEQQTPFTSLLMLPNRATTGGVILWDNNPSDQSTQIWDFHLGHSRGYEECGLLEAEYGVNDAGFVIKSYSELMKETSFTNTKVVGEMYDINYSMTHEDITSFNNNSNNPTASQGAATSESNNLPIARPSSGSAFAKPKSFSGSKDIELTEQSILMRGESGRTAATTKVDLEQLAQNRGNAMLRYKEKKKTRRYDKHIRYESRKARADTRKRVKGRFVKATEAPDG

SEQ ID NO: 284 - protein, 529 aa, Vitis vinifera
METTSKSRPSAAVPCDFCDSKTAVVHCRADSAKLCLLCDRHVHSANALSRKHLRSQICDNCRTEPVSFRCFTDNLALCQSCDWDSHGNCSVPSLHERTPVESFSGCPSPLELASVFRVDLKDGNWSSWNFGSVNVQDFVVPGENCYAGCGTKVEKNGISVVYEQLVDLIRSDVDVVRGDVDGDGDEGEDGAELGPGTPGRCANMGNFQGVDLDNGDDEELLRQQTPFTSLLMLPTPVDARDTGCGYGCAVEGDAMWDRGHLSYQAPQSQIWDFHLGRSRICKETSPEAGYDVDNSGFVIKNYSEITKGSSLTRTKALQGMYEMNCTTTHEDILSKNCPLGHGSMIYSKTGGLGTPLNHVAICKGLEFCSCCPFEKHTSHYCCEFSEDTGTPDGGNGIGVIVAPFLKNVNKQRLYSHSNKALSSQGPTTAESNNIPIVGPSSESWTAEPNTNSIKSMQFKDLLIGSGTARTETTNVDMELLAQNRGHAMLRYKEKKKTRRYEKHIRYESRKARADTRKRVKGRFVKASDS

SEQ ID NO: 285 - protein, 391 aa, Vitis vinifera
MLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPVLPIAGCLYGPPATDPGGTVVRSAAEADNGFLGQEAEETIDEEDEDEAASWLLLNPVKNNNGSSNNQNNGLLFGGEVDEYLDLVEYNSCPENQFSDQYNQQQPPPHYSVPHKNYGGDRVVPVQCGEAKGQLHQQHQQQGFHLGMEYESSKAAYSYNPSISHSVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 286 - protein, 410 aa, Vitis vinifera
MITDKKVANAMGGKTARACDNCLHKRARWYCGADDAFLCQACDASVHSANQLAERHERVRLQAASCKNADSMRDNSTPAWHQGFTRKARSPRNVKRTSVQPSKHENKFPTPPPLVPEIGSEEASPDENEEQFLFRVPTFDPFVAELNNDGIREIGMENDSKPLSDYGHEEIGDLDSLTGFLPSEMDLAEFAADVESYLGAGLDEDSCGIKGIGVLDCEQGDMDACFGDQKVKVKEERVETDATFHLDPELDMTKELLAWNLDYESTVMDEEEHEEKMVAAVEMRRKISLSLNYEDVITAWASQGSPWTTGNRPEFDPNDYWPDYMGACPTNVHGPCGDVGGVGGNFGGRDGGREARVLRYREKRRTRLFSKKIRYEVRKLNAEKRPRMKGRFVKRASFAAGPCFPILNVK

SEQ ID NO: 287 - protein, 401 aa, Vitis vinifera
MGQLCDFCGDQRSMVYCRSDAACLCLSCDRNVHSANALSRRHSRTLLCERCNSQPATVRCVEEKISLCQNCNWIGHGSTTSASDHKRQTINCYSGCPSAAELSRIWSFVLEFLSVDDSNCEQGMVLMSLTENSVGSCSLPPVNNNINDSTVAGRTNAQENVDKSDLWMASSPVPALNPISSSVDQPTDLVNSPTTKLCCSGICDDDDLLYEDFSMADVDLSIENYEELFGVSQNHSEQLLENGGIDSLFGIGNLPAGSCQEPLTMQPACSNPISADSIISSKTDPNLCFPPRQAHSSLSLSFSGLTGESSTGDYQDCGVSSMLLMGEPPWCSPCPENSLPSANRDSAVLRYKEKKKARKFEKKIRYASRKARADVRKRVKGRFVKAGDAYDYDPLNQTRSF

SEQ ID NO: 288 - protein, 410 aa, Solanum tuberosum subsp. andigena
MLKKEKSGGFDGSSNNWARVCDSCHSATCTVYCRADSAYLCAGCDSRIHAASLMASRHERVWVCEACERAPAAFLCKADAASLCASCDADIHSANPLARRHHRVPIMPIPGTLYGPPAVHTVSGGSMMIGGTTGEGTEDDGFLSLTQDADDTTIDEEDENEAASWLLLNPPVKNNNKNNINNNNNNQNNNYGMLFGGEVVDDYLDLAEYGGDSQFNDQYSVNQQQQRYSVPQKSYVEDSVVPVQNGQRKSLILYHQPQQQQQQSHHLNFQLGMEYDNSNTGYGYPASLSHSVSISSMDVSVVPESALSETSNSHPRPPKGTIDLFSGPPIQIPPQLTPMDREARVLRYREKKKNRKFEKTIRYASRKAYAETRPRIKGRFAKRTDVEAEVDQMFSTQLMTDSSYGIVPSF

SEQ ID NO: 289 - protein, 413 aa, Zea mays
MTSAGAATGAALGARTARSCDGCMRRRARWHCPADDAFLCQTCDVSVHSANPLARRHHRVRLPSASCSSPPRDPDAPTWLHGLKRRPRTPRSKPGGSKSNKHEATPSFIAAAASSAAVPDLEAEESGSGILGGNDDHHGFLQDDDEDLLYRVPVFDPMLAEFYNPVADEGEQKPACSLLMPSLAETSPEFASGGSAEADGLSVSFHVPDMELASFAADMESLLMGVDDDGFDCLGFLDEEKPQVNADLDAIVAPAPEPEDKKRKRPEMILKLNYEGVIASWVRDGGSPWFHGERPHLDCHELWSDDFTTGSRELLGGAVTPVTGGEREARVSRYREKRRTRLFAKKIRYEVRKLNAEKRPRMKGRFVKRATLPPLPRPPPPQQQQQQKQLPRAPPHVGMVLPPPPVSNGRLWF

SEQ ID NO: 290 - protein, 452 aa, Zea mays
MIATTRGSSAKAAAAVGGKAARACDGCLRRRARWYCAADDAFLCQGCDTSVHSANPLARRHERLRLCPASPLQTPPDRSAAAAATATNKRERHDEVAVPAWFGRKARTPRGGHAKSVGQVALSRRLVVPHAAGGDSDSPDERNGGEEEQLLYRVPILDPALAEFCSPPPLEDAAGLALDASVCNEDGAIEDPAKPDPAAPLAQFCPVSGHFNFGPTDAELREFAADMEALLGHGLDDGNEEDSSFYMETLGLLDPMEVGDDATQVKVETDGSSACCEASGTLACGLELDLEASDEMLDIDFDYASPQDTATDERAASSDTGADAQFLQTSLSLTLNYEAIIQSWGSSPWTGGGERPHVKLDTRWPHDYTNMWVVGGVVGHGGEDLPGTPRLGMDGGREARVSRYREKRRTRLFSKKIRYEVRKLNAEKRPRMKGRFVKRATAGGSLAIAGLA

SEQ ID NO: 291 - protein, 364 aa, Zea mays
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAASEADEQHAAAEHAHAHALNLNVEAKDMKLDYLFSELDPYLSVEIPRFQHADSVVPNGAGAAVELDFTCGIGVKHSSYSSYTATSLAHSGSSSEVGVVPEAFGGSGSGGGSFELDFTRPKPQAYMPYTGTPQSHSVPSADVEVVPERGDLAAVRPVPLMGESREARLMRYREKRKNRRFEKTIRYASRKAYAETRPRIKGRFAKRADHDGDADADDAEAEAEAEAAVPMSYVLDFGYGVVPSF

SEQ ID NO: 292 - protein, 407 aa, Zea mays
MGALCDFCGEQRSMVYCRSDAASLCLSCDRNVHSANALSRRHTRTLLCDRCASQPAMVRCLAENASLCQNCDWNGHIAGSSSAGHKRQTINCYSGCPSSAELSRIWSFVSDIPNVAPEPNCEQGISMMSISDSGVSNQDNAAGDSILLDIASATLVSDIGTCDKLLVGSSSGAGVNLLPLVTGQTETAGSVDSTPDKVPYTPDKDMFSKDSIYEDFCVDDADLAFENYEELFGTSHIQTEQLFDDAGIDIYFEMKEAPAGNSTESKLKQPANSNAVSADSGMSNPGVKGDSSVCTPLRQARSSLSLSFAGLTGESSAGDNQDCVVSSLLLMGEPPWQPPGPEGSIAGGSRDSALTRYKEKKMRRKFDKKIRYASRKARADVRKRVKGRFVKAGEAYDYDPLCQTRSY

SEQ ID NO: 293 - protein, 456 aa, Zea mays
MIATTTTGSSAKAAAVGGKEARACDACLRRRARWYCAADDAFLCQACDTSVHSANSLARRHERLRLRPTSPLQTPPPPTPASAKRESHDEVVPAWFKRKARTPRGGRAKSDVRTLSRRLVVPHAAGGDSPDGRNDEGEFEAEEPEEEVLYRVPVFDPALAEFCSPQPLEDAAALASSCNEDGAVEDPAKTDRETPAAAPLVQFFPDGGHANFGPTDAELREFAADMEALLGYGLDDGNEESSSFCMETLGLLEPVEVGEDASRVKVETDAGSACEASGTLACALELLDPDASDEMLDIDFNYGSPQDTTTTENAASSSHTGTDGQFLQTSLSLTLNYEAIIQSWGSSPWTGGAERPHVKLDDSWPHDCTNMWVVGRGMVGHGGEDLLGTPRLGQGMDDVGREARVSRYREKRRTRLFSKKIRYEVRKLNAEKRPRMKGRFVKRATAGGSLTIAGLA

SEQ ID NO: 294 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 295 - protein, 348 aa, Brassica nigra
  misc_feature (321)..(321): Xaa can be any naturally occurring amino acid
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAXRNEVDADQAFPTVVMFDTGYGIVPSFS

SEQ ID NO: 296 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTRYGIVPSFS

SEQ ID NO: 297 - protein, 348 aa, Brassica nigra
MLKQESNWAQACDTCRSAACTVYCRADSAYLCTSCDAQIHAANRLASRHERVRVCESCERAPAVFFCQADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 298 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 299 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSIIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 300 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 301 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 302 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADQALSTMVVFDTGYGIVPSFS

SEQ ID NO: 303 - protein, 342 aa, Brassica nigra
  misc_feature (15)..(15): Xaa can be any naturally occurring amino acid
  misc_feature (31)..(31): Xaa can be any naturally occurring amino acid
  misc_feature (40)..(40): Xaa can be any naturally occurring amino acid
  misc_feature (113)..(113): Xaa can be any naturally occurring amino acid
  misc_feature (315)..(315): Xaa can be any naturally occurring amino acid
MLKQESNWAQACDTXRSAACTVYCRADSAYXCTSCDAQIXAANRLASRHERVRVCESCERAPAAFFCKADAASLCTACDSQIHSANPLARRHQRVPILPISGCVATNHHSSEXTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAXRNEVDADHALSTMVMFDTGYGIVPSFS

SEQ ID NO: 304 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 305 - protein, 348 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMVDTGYGIVPSFS

SEQ ID NO: 306 - protein, 342 aa, Brassica nigra
  misc_feature (177)..(177): Xaa can be any naturally occurring amino acid
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFXGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 307 - protein, 344 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDHNNNNNSENNRFSVGEEYLDLVDYSSSMDKRFTGQSIQYQQDYNVPQRSYVADGVVPLQVGVANGHMHHKKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 308 - protein, 342 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDANHALSTMVMSDTGYGIVPSFS

SEQ ID NO: 309 - protein, 345 aa, Brassica nigra
  misc_feature (344)..(344): Xaa can be any naturally occurring amino acid
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSXS

SEQ ID NO: 310 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 311 - protein, 345 aa, Brassica nigra
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGLSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 312 - protein, 420 aa, Sorghum bicolor
MTTSAGAAAGAALGARTARSCDGCMRRRARWHCPADDAFLCQTCDVSVHSANPLARRHHRVRLPSASCSSPPCDPDAPTWLHGLKRRPRTPRSKPGGGKHEATTPNSMAAAASAAVPDLEAEESGSGIVGDNDDHGFLVDDDEDLLYRVPVFDPMLAEFYNPVADEGEQKPLAEFYNLVADEGEQKPACLMPPLVETSPEFASGGLAEADGLSGFDVPDMELASFAADMESLLMGVHDGFDDLGFLDEEKPQVNADAYLEAMAAPVPEREDKKRKRPEMILKLNYDGVIASWVRDGGSPWFHGERPHLDPYELWSDFPAGSRGLLGGAVTAVTGGEREARVSRYREKRRTRLFAKKIRYEVRKVNAEKRPRMKGRFVKRTTLPPLPRPPPQQQQKQLPRALPHVGMVLAPPPGANGRFQF

SEQ ID NO: 313 - protein, 376 aa, Sorghum bicolor
MEALVAGRYWGVGGRRCEACGGSPAAVHCRTCPGGGAYLCAGCDAGHARAGHERVWVCEVCERAPAAVTCRADAAALCAACDADIHDANPLARRHERVPVQPIGAAAAAPAAETLLFGAAAEENQDDDDGAAAAAKVVGVDAGKLADFLFADVMDPFFGQDFTGILRRRVALWTLTFGGGVAAAAVAAKPSYSSYTAASLGHSGSSSEVGLVPDAMCGRGGSVTGGVIELDFAQSKAAYLPYAATPTHSMSSLDVGAVPERGDGVMAGRVATPPAAAAAESREARLMRYREKRKNRRFEKTIRYASRKAYAESRPRIKGRFAKRADDNDADADADFDFDAGAAAATAPARSRSQQQQPSYPYVLDFAAGYGVVPTF

SEQ ID NO: 314 - protein, 488 aa, Sorghum bicolor
MSSSKHAAAGAGAVGGKAARACDSCLRRRARWYCAADDAFLCQGCDASVHSANPLARRHERLRLRPMTSPPDPAHSTLEAGGVGVASTSTWKKRQQQQQQVAPAWSKRKARTRRPHVKSVGQLLSRKLVVVPEVATVESSEERKVEEEDEEEEEEEEQLLYCVPTFDRALAELCTPPPPLDDPTATASSSCCRDNDVDGAVDNAKAAPPAVVVAESPVQQLPDSFAGFGPTDAELREFAADMEALLGQGLGDSNELDESFYMESLGLMTTTQQAEDVDVGRVKMEPNGSVISRSRGEGAPGFGPAELMKPEASSAEVLVLDIDFNCSSPTVMMDHEDEDSFEHKASASNGDAAAAGTQFLKRSLDLSLNYEAIIESWGSSPWTDGQRPNVQLDDFWPHAHLTGWMAGGGRLGGEAAAVSPRLGMVGGREARVTRYREKRRTRLFAKKIRYEVRKLNAEKRPRMKGRFVKRPAAAGGGGAAIAAPCAVT

SEQ ID NO: 315 - protein, 406 aa, Sorghum bicolor
MASLCDFCGKQRSMIYCRSDAASLCLSCDRNVHSANALSRRHTRTLLCDRCGSQPASVRCLEDNASLCQNCDWNGHDAASGASGHKRQAINCYSGCPSSAELSRIWSFIMDIPTVPAEPNCEDGLSMMTIDDSDVTNHHDASDDKRLLEIANTTLMSDPPSADKPKPLISSSSGDGFDVLPLATDQPAGSVSVTPKVPYARDDDNFNDGMYEDLCVDDADMTFENYEELFGTSHIRTEELFDDAGIDSYFEMKETQPFDFNEEPKTMQLECSNVVSADCGMLNPGARADSSLCIPVRQVRSSISHSLSGLTGESSAGDHQDCGVSPMLLMGEPPWHSPGPEGSVAGGSRDSALTRYKEKKKRRKFDKKIRYASRKARADVRKRVKGRFIKAGEAYDYDPLSQTRSY

SEQ ID NO: 316 - protein, 329 aa, Sorghum bicolor
MEGDEKSAGGAPAYWGLGARPCDACGADAARLYCRADSAFLCAGCDARAHGAGSPNARVWLCEVCEHAPAAVTCRADAAALCASCDADIHSANPLARRHERLPVAPFFGALADAPKPFASSAAAVPPKATAGADDDGSSEAEAASWLLPEPDHGHKEEGATTEVFFADSDPYLDLDFARSMDDIKTIGVQGGPPELDLNGAKLFYSDHSMNHSVSSSEAAVVPDAAAGAAPVVAVVSRGLEREARLMRYREKRKSRRFEKTIRYASRKAYAETRPRIKGRFAKRTPGAGEDPLEEHEEMYSSAAAAVAALMAPGGADADYGVDGVVPTY

SEQ ID NO: 317 - protein, 474 aa, Sorghum bicolor
MIATTGSSAKTAAAAAVGGKSARACDGCLRRRARWYCAADDAFLCQGCDTSVHSANPLARRHERLRLQPAAASSSPLHTPPRTGAAANNKRERHDEVVPAWFRRKARTPRGGHAKSVGGQALSRSRRLGVVVPHAAAGGGDSPDDGRSAEGEFEAEEEQLLYRVPIFDPALAEFCSPPPAPLEDAAALASSCNEDGAVEDPANSKPDPGPATPAPAPVVQFFPDSGHANFEPTDAELREFAADMEALLGHGLDDGNEEDSSFYMETLGLLDPVEVGDDATRVKVETDGGSACGEASGTLACALELLDPAEVSDEMLDIDFNYGSPLDTMMDDEKAASSDTGGADDAQFLQTSLSLTLNYEAIIQSWGSSPWTAGGERPHVKLDDSWPHTNMWVVGGVAGHGGEDLLLGTARLGMDGGREARVSRYREKRRTRLFSKKIRYEVRKLNAEKRPRMKGRFVKRATAGGSSLAIAGLA

SEQ ID NO: 318 - protein, 411 aa, Sorghum bicolor
MNYNFSSNALDEEEVAGRGGEGGSCAAAPAWARPCDGCRAAPSVVYCHADAAYLCASCDVRVHAANRVASRHERVRVCEACERAPAVLACRADAAALCVVCDAQVHSANPLAGRHQRVPVLPLPVAAIPAASVLAEAAATAVAVGDKQEEEVDSWLLLTNTKDPVSDNNNCNCSSSSNNNISSSNTSTFYADVDEYFDLVGYNSYCDNHINSNPKQYGMQERQQQQQLLLQKEFGDKEGSEHVVPASQVAMANEQQQSGYGVIGVEQAASMTAAVSAYTDSITNSISFSSSMEVGIVPDNMATTTDMPNSGILLTPAEAISLFSSGSSLQMPLHLTSMDREARVLRYKEKKKSRKFAKTIRYATRKTYAEARPRIKGRFAKRSSDMEIEVDQMFSSAALSSDGSYGTVLWF

SEQ ID NO: 319 - protein, 406 aa, Sorghum bicolor
MGALCDFCGEQRSMVYCRSDAASLCLSCDRNVHSANALSRRHTRTLLCDRCASQPAMVRCLAENASLCQNCDWNGHIAGSSAAGHKRQTINCYSGCPSSAELSRIWSFVSDIPNVAPEPNCEQGISMMSISDSGVSSQDNAAGDNNLLDIASETLISDLGTCDKPLVGSSSGAGVNLLPLATDQTAGSVDSPPDKVPYTPDKDMFSKDSIYEDFCVDDVDLAFENYEELFGTSHIQTEQLFDDAGIDSYFEVKEAPAGNSTEQSKLKQPANSNAVSADSGMSNPGVKGDSSVCIPLRQARSSLSLSFSGLTGESSAGDHQDCVVSSLLLMGEPPWQPPGPEGSIAGGSRDSAITRYKEKKKRRKFDKKIRYASRKARADVRKRVKGRFVKVGEAYDYDPLCQTRSY

SEQ ID NO: 320 - protein, 426 aa, Ricinus communis
MEEYSDSAPRNSLFVRLCDFCNSEAAILYCRADSAKLCLFCDQQVHSANALSLNHFRSLNCDKCGAEPASVQCSVINDNNNNDLVLCQDCDFDCSVSLSLLKRAHINGFMGCPNAVELGEILGFDLKKTKLFASSDSGSDLYDQEMDNMQDLLVPSGNSSRNCRQEMYKQLLELGKRERVKVNGDGDGEELRPETPPSRCGQQGNLVNLQMKNGNEEEFHHQERPFASMLMLPNLEDVRESDGAADGVLLWDCNPTYQAAQVWDLDLGKTRDCAEPGEEEANYDATDPGFTFNNHRISKDSAFNIIKVCSKQQVLQSTMETGGGKDTLLVEQSSDSLLAEAKSNNSPRHVEVVEKSHLAWVGTDDMETSKADVELFAQNRGNAMLRYMEKKKTRRYDKHIRYESRKARADTRERVKGRFVKASENC

SEQ ID NO: 321 - protein, 468 aa, Ricinus communis
MISNKNVANAVAGKTARACDSCVRKRARWYCAADDAFLCQSCDSSVHSANPLARRHERVRLKISSLKSLDIISKGSSVITVPSWHQGFTRKARTPRNGHGNKPLLSLLKIEEKSRNPIPLVPEVGSDDQISHEDNNEEEQLLYRVPIFDPFVAELCTPTTISNEADQTTTAPFTAGGGNGNDTDQTVAGANGIESKASYLHGFLPSETDLADFAADVESLLGRGLENESFGMEDLGLVDCKEEKQFKMQEREFSLASGQVIKLEEEEKEEEEAVRECHIDTEIDMAKEPPFELSFDYDSATCGEEDEKVATPQRDIKSNNGEYKDNTRSKNDNKKKRKILLSLDYEAVITAWATQGTSPWTDGTRRDVDPDECWQDCMGTCGAEFHHPYGDTNGLGGVGGGGNPAMAGGGREARVSRYREKRRTRLFSKKIRYEVRKLNAEKRPRMKGRFVKRATFAGGPSAFPLHAK

SEQ ID NO: 322 - protein, 378 aa, Ricinus communis
MLKEENTGGGGGNNWARVCDTCRAAACTVYCKADSAYLCATCDARIHAANRVASRHGRVWVCEACERAPAAFLCKADAASLCATCDADIHSANPLARRHQRVPIHPISGCLHGPQAGPVGGGGETTTEDMFMTEDGEDGVGEEEEDEAASWLLLNPVKNGNSQNNGTNGFLFGGEVEEYLDLFEYNSNSCGENQYADNHQHYSGTVHQKSHEGDSVVPVRCGDGAGKDHVHQQYHNFQLGLEFESSKAAYSYNGSISHSVSISPMDVGVVPDSTMSEASISHPRPPKGTIDLFSGPPIQMPSQLSPRDREARVLRYREKKKTRKFEKTIRYASRKAYAETRPRIKGRFAKRTDVEVEVDQIFSTALMAETGYGIVPSF

SEQ ID NO: 323 - protein, 430 aa, Ricinus communis
MTNDRKAANALSGKTARACDGCSRKRARWFCAADDAFLCQACDDSVHSANQLASRHERVRLETASSKISGSRNTVDSVPAWHQGFIRKARTPRNSSNKQQLKDEDKVLVMNPLPLVPEIGGEEEGNSTFADEDDDRLLYRVPVFDPYASELCTDDMVTCGEGTEITMGNEEGNIVFDGYNGQEGTCDDLDILPEFFSSDMDLAEFAADVENLLGVNEDSPDIEDLCLLHCKEEEDDQKCFFDDQDKVVMKVKDEQEVEACDHFDQAFERESLDWSFNYESPTITADEVEEKKRVPVAINSQQKKETKSTASLLRLNYEDVINAWASQGSPWTSGSRPELNSDDCWPDCMDICLKDGHHHPYGGMGGHTRGGNGAREARVLRYKEKRRTRLFSKKIRYEVRKLNAEKRPRMKGRFVKRTSFMGNGFPYMNK

SEQ ID NO: 324 - protein, 365 aa, Magnolia virginiana
MDGDSSTRRWARVCDSCRSAACTAYCRADAAYLCAGCDSRTHAANRVASRHERVWVCESCERAPAAVSCKADAAALCTACDVDIHSANPLARRHHRTPILPISGQLYSSPHESVHDREPGGAHEEDEDEDGDGDDEAASWLLLNPVKNSNQNNGYGYGGEVDEYLDLVGYNNSCNENQNEGQSIQLHQNLGKNEGDDSVVPVQFLAGDEQQQQQQQQQNLQLDLDMEFEESKAGYNYTASMSQSVSYSSMDASVVPDATAMTDISNSHVRPPKGTIDLFAGPPLQMMPAQFSPMDREARVLRYREKKKTRKFEKTIRYASRKAYAETRPRIKGRFAKRTDVEVEVHQMFSTTVMAESRYSIVPSF

SEQ ID NO: 325 - protein, 407 aa, Zea mays
MASLCDFCGKQRSMIYCRSDAASLCLSCDRNVHSANALSRRHTRTLLCDRCGSQPASVRCLEDNASLCQNCDWNGHDAESGASGHKRQAINCYSGCPSSAELSRIWSFITDIPTVAAEPDYEDGLSMMTIDGSDVTNRHDTSDDKRLLEIANTTLMSDPPSADKLKSPTGSSSGDGFDVMTLATDQPAGPVSATPKVPNARDDDKFNDGMYEDLCVDDADLTFEDYEELFGTSHIRTEELFDDAGIDGYFELKETPPFYFNEQPKAMQIECGNVVSADCAMSNPGARADSSLCIPVRQVRSSISHSLSGLTGESSAGDHHDCGVSPMLLMGEPPWHSPGGPEGSVAGGSRDSALTRYKEKKKRRKFDKKIRYASRKARADVRKRVKGRFIKAGEAYDYDPLSQTRSY

SEQ ID NO: 326 - protein, 374 aa, Glycine max
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 327 - protein, 365 aa, Glycine max
MGIERGGLKGFRSGWSVPPKKPCDSCKLASAALFCHLDSAFLCIACDSKIHCANKLASRHERVWMCEVCEQAPASVTCKADAAALCVTCDSDIHSANPLAQRHERVPVEPFFDSAESIVKASATASFGFVVPSDDGAASDVFAPDDSDSAAWLIPNPNFGSKLMDAPEIKSKEIFFSEMDPFLDFDYSNSFQNHNSAVNDSVVPVQTKPSLAPPPINNHQHHHQSETCFDIDFCRSKLSSFNYPSQSLSQSVSSSSLDVGVVPDGNTVSDMSYSSGIVVSGGQGATQLCGMDREARVLRYREKRKNRKFEKTIRYASRKAYAETRPRIKGRFAKRTEIDSDVERLYSPGAAALMLDTPYGVVPTF

SEQ ID NO: 328 - protein, 366 aa, Glycine max
MKDAGALGGKTARACDSCVSRRARWFCAADDAFLCHGCDTLVHSANQLASRHERVRLQTASSKVTTTHAWHSGFTRKARTPRHNSKHFALQQRLKDEVLFNNTSVLPLVPELGGEEQEPVVVDNDETEEQMLCRVPVFDPFDVRTDDLDSFSDMDFAEFAADVESLLDKEDDEISACVGGGEGEGEGVQGAMVKVKDEEEIDGDVACYLESVFDDAFHWNNIESVLSDAREEKEGVVACDVGVGDEEGGTKRDIFLRLNYDEVITAWSSQGSSPWTTSNPPKFNSDYDFSLGLSGVGGEVRSLRGHLDGGREARVSRYREKRRTRLFAKKIRYEVRKLNAEKRPRMKGRFVKRTCFVGANAFPAYH

SEQ ID NO: 329 - protein, 411 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSVSSSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 330 - protein, 411 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNKDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSVSSSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 331 - protein, 291 aa, Oryza sativa
MNYNFGGNVFDQEVGVGGEGGGGGEGSGCPWARPCDGCRAAPSVVYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNISFSSMEAGIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDSSYGTVPWF

SEQ ID NO: 332 - protein, 451 aa, Oryza sativa
MNYNFGGNVFDQEVGVGGEGGGGGEGSGCPWARPCDGCRAAPSVVYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNSSNNGMYFGEVDEYFDLVRYNSYYDNNNNDNSNSNSSNNDNDNDNDNNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSVSSSISFSSMEAGIVPDSTVIDMPNSSILTPAGAINLFSGPSLQMSLHFSSMDREARVLRYREKKARKFEKTIRYETRKAYAEARPRIKGRFAKRSDVQIEVDQMFSTAALSDSSYGTVPWF

SEQ ID NO: 333 - protein, 413 aa, Oryza sativa
MNYNFGGNVFDQEVGVRGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSNNNNNNNNNNDNDNDNNDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNRVSSSISFSSMEAGIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 334 - protein, 412 aa, Oryza rufipogon
MNYNFGGNVFDQEVGVGGEGGGGGEGSGCPLARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSNNNNNNNNNNNDNDNDNNDNNNSNSSNNGMYFGEVDEYFDLVGYNSYYDNRIENNQDQQYGMHEQQEQQQQQQEMQKVFAEKEGSECVVPSQITMLSEQQHSGYGVVGADQAASMTAGVSAYTDSISNSVSSSISFSSMEAGIVPDSTVIDMPNSSILTLAGAINLFSGPSLQMSLHFSSMDREARVLRYREKKKARKFEKTIRYETRKAYAEARPRIKGRFAKRSDVQIEVDQMFSTAALSDGSYGTVP

SEQ ID NO: 335 - protein, 415 aa, Oryza barthii
MNYNFGGNVFDQEVGVGGEGGGGGEGSGCPWARPCDGCRAALSVVYCRADAAYLCASCDARVHAANRVASRHERVRVCEACERAPAALACRADAAALCVACDVQVHSANPLARRHQRVPVAPLPAITIPATSILAEAVVATATVLGDKDEEVDSWLLLSKDSDNNNNNNNNNDNDNDNNNNSNSNSNSSSNGMYFGEVDEYFDLVGYNSYYDNRIENNQDQQYGMHEQQEQQQQQQEMQKEFAEKEGSECVVPSQITMLSEQQHSDYGVVGADQAASMTAGVSACTDSISNRVSSSISFSSMEASIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 336 - protein, 407 aa, Oryza longistaminata
MNYNFGGNVFDQEVGGGEGAAGGGGCPWARPCDGCRAAPSVVYCRADAAYLCASCDARVHAANRVVSRHERVRVCEACERAPAALACRADAAALCVACDVQVHSANPLARRHQRVPVAPLPAVAIPATSVLAEAVVATATVLGDKDEEVDSWLLLTKDPDNKNNDDDNNNNNNNKNNNNNNSNNGMYYGEVDEYFDLVGYNSYYDNRIENSQDQQYGMHEQQEQQQQQQQQQEMQKEFAEKEGSECVVPSQITMLSEQQHSGYGVVGADQAASMTAGVSAYTDSISNSISFSSMEVGIVPDSTVIDMPNSSILTPAGAINLFSGPSLQMSLHFSSMDREARVLRYREKKKARKFEKTIRYATRKAYAEARPRIKGRFAKRSDVEIEVDQMFSTAALSDGSYGTVPWF

SEQ ID NO: 337 - protein, 366 aa, Brassica napus
MFKQESNNIGSEENNTGPRACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 338 - protein, 366 aa, Brassica napus
MFKQESNNICNRENNRGARACDTCGSTICTVYCHADSAYLCNSCDAQVHSANRVASRHKRVRVCESCERAPAAFMCEADDVSLCTACDLEVHSANPLARRHQRVPVVPIIGNSCSSLATANHTTVTEPEKRVVLVQEDAKETASWLFPKNSDYHNNNNNQNNELLFSDDYLDLADYNSSMDYKFTSQYNQPRHKQDCIVPEKNYSGDRVVPLQLEETRGNLRNKQQNITYGSSGSQYNNNGSINHNAYNPSMETDFVPEQTAPDTTVSHPKTHKGKTAQLPEPLIQILSPMDREARVLRYREKKKRRKFEKTIRYASRKAYAERRPRINGRFAKMSETEVEDQEYNTMLMYCDTGYGIVPSFYGQK

SEQ ID NO: 339 - protein, 368 aa, Brassica napus
MFKQESNNNICNRENNRGARACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 340 - protein, 343 aa, Vitis vinifera
MALLYCRADSAKLCLSCDREVHSTNQLFTKHTRSRLCDVCDASPASILCSTDNLVLCQNCDWAKHGRSLSSAHDRRPLEGFSGQPSVTELLAFVGFEDLGKKSLFCGDESEFSDFLVWDTPAVVNLDDLIVSTACDHNFQAMGVPPLPKNRGAPCGQHKAEIIHQLRQLAKIELSFDFDHGDAKPPIGFQSHIPKQLIQKENECNSCDHEVEFVFPTYEASAFQWCSDGSEAANQVLPSVLLGSCADEKCLVPRKHSDIGGSVSHTNGSDEGKSECPVVTKTLPALPKVSVHELNSQERDSAISRYKEKKKTRRYEKHIRYESRKARAESRIRIKGRFAKMDH

SEQ ID NO: 341 - protein, 448 aa, Oryza sativa Japonica Group
MNYNFGGNVFDQEVGVGGEGGGGGEGSGCPWARPCDGCRAAPSVGYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNSSNNGMYFGEVDEYFDLVGYNSYYDNNNNDNSNSNSSNNDNDNDNDNNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDSSYGTVPWF

SEQ ID NO: 342 - protein, 501 aa, Oryza sativa Japonica Group
MNYNFGGNVFDQEVGVGGEGGGGGGEGSGCPWARPCDGCRAAPSVVYCRADAAYLCASCDARVHAANRVASRHERVRVCEACEQAPAALACRADAAALCVACDVQVHSANPLARRHQRVPVAPLPAITIPATSVLAEAVVATATVLGGKDEEVDSWIILSKDSNNNNNNNNSNSSNNGMYFGEVDEYFDLVRYNSYYDNNNNDNSNSNSSNNDNDNDNDNNNNSNSSNNGMYFGEVDEYFDLVRYNSYYDNNNNDNSNSNSSNNDNDNDNDNNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSSILTPAGAINLFSGPSLQMSLHFSSMDREARVLRYREKKKARKFEKTIRYETRKAYAEARPRIKGRFAKRSDVQIEVDQMFSTAALSDSSYGTVPWF

SEQ ID NO: 343 - protein, 481 aa, Oryza sativa Japonica Group
MSSTAKAAAAGAVGAKSARACDGCLRRRARWYCAADDAFLCQGCDTSVHSANPLARRHERLRLRPSSPPPLVPPSGSGRRDEAVPAAWFKRKARTPRSHAAKSAAAFGQLLSRRLVVVPEAAAGSGGDSPEERKDEGEIVEEQEQLLYRVPIFDPALSEFCSPPPLEDAAAAVSCCNEDGAVENPTKPSMTTTTATTPPLQFFPDGQANFGPTDAELREFAADMEALLGRGLDDGNDEDSFCMETLGLIEPVDDDAGRVKVEADGDAGMTLAWCHELDTETSSGEMLDIDFDCGSPQAATTPDEKVGSSGPAAADDDAQLQQSNLALSLNYEAIIESWGTSPWTDGERPHVKLDDSWPRDYSVRATPCTPYASSHRILHNLAGTDDLLRRRAAVQGVWMAAAGVFGHGGEEQALTPRLGMDGGREARVSRYREKRRTRLFSKKIRYEVRKLNAEKRPRMKGRFVKRAAAAATAAVATACVA

SEQ ID NO: 344 - protein, 379 aa, Arabidopsis lyrata subsp. lyrata
MGYMCDFCDEQRSMVYCRSDAACLCLSCDRNVHSANALSKRHSRTLVCERCNAQPASVRCSDERVSLCQNCDWLGHDGKNSTTTTSNHKRQTINCYSGCPSSAELSSIWSFFMDLNISSAGESACEQGMGLMTIDEDSTGEKSGVLNVNVDQPETSSAAQGMDRSSVPENSSLAKELGVCEDDFNGNLITDEVDLALENYEELFGSAFNSSRYLFEHGGIGSLFEKDEAPEGSNKGNEMQQPAVNNNASADSFMTCRTEPIICYSSKPTHSNISFSGITGESNAGDFQDCGASSMKQLLREPQPWCHPTAQDIIASSHATTRNNAVMRYKEKKKARKFDKRVRYVSRKERADVRRRVKGRFVKSGEAYDYDPMSPTRSY

SEQ ID NO: 345 - protein, 330 aa, Arabidopsis lyrata subsp. lyrata
MEARCDYCETEKALIYCKSDLAKLCLNCDVNIHSANPLSQRHTRTLLCEKCFLQPTVIHCMNEKVSLCQGCQWTATNCTGLGHRLQNLNPYSGCPSPSDFAKIWSSILEPSVSNWVSPFPDTLLQELDDWNGSSTSVITQTQNLKDYSSFFSMESNLPKVIEEECSGLDLCEGINLDDAPLNFNASNDIIGCSSLDNTKCYQYEESFKEENNIGIPSLLLPALSGNVVPSMSISMSNITGENSATDYQDCGISPGFLIGDSPWESNVEVSFNPKSRDEAKKRYKQKKSKRMFGKQIRYASRKARADTRKRVKGRFVKSGETFEYDPSLVM

SEQ ID NO: 346 - protein, 360 aa, Arabidopsis lyrata subsp. lyrata
MASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYLSDIDGNGSREEEEEEAASWLLPNPKTTTTATAGMVAVTAAEEVPGDSPEMNTGQQYLFSDPDPYLDLDYGSVDPKVESLEQNSSGTDGVVPVENRTVRVPTVNENCYEMDFTGGSKGFAYGGYNCISHSVSSSSMEVGVVPDGGSVADVSYPYGGPATSGADPGSQRAVPLTSAEREARVMRYREKRKNRKFEKTIRYASRKAYAEMRPRIKGRFAKRTDTSESSDVVGHGGIFSGFGLVPTF

SEQ ID NO: 347 - protein, 371 aa, Arabidopsis lyrata subsp. lyrata
MLKQESNEIDSEENNRARACDTCRSNACTVYCHADSAYLCMSCDAQVHSANRVASRHKRVRVCESCERAPAAFLCEADDASLCIACDSEVHSANPLSRRHQRVPILPISGNSFSSMATHHQSETTMTDPEKRLVVDQEKGEEGDEDAKEVASWLFPNSDKNINNQNNGLLFSDEYLDLVDYNSSMDYKFTGQYHQHQQNCGVPQTSYGGDGVVPLQLEESRRHQCHNQQNFQFDIKYDSSGSHYNDNCSLNHNVYILSMETGVVPESTARDKTASPPRTPKKTTDQLPDPPIQMITQLSPMDREARVLRYREKKKTRKFEKTIRYASRKAYAEIRPRVNGRFAKRREIEAEDQVFNTMLMYDTGYGIVPSC

SEQ ID NO: 348 - protein, 348 aa, Arabidopsis lyrata subsp. lyrata
MMKVESNWGQACDTCRSAACTVYCRADSAYLCTSCDAQVHAANRLASRHERVRVCQSCERAPAAFFCKADAASLCTTCDSEIHSANPLARRHQRVPILPISENSYSSTATNHSCETTVTDPENRLVLGQGEEDEDEAEAASWLLPNSGKNNGNNNGFSIGDEFLDLVDYSSSDKQFTDQSNQYQLDCNVPQRSYEDGVVPLQVEVSKGHMNHEQQNFQLSITCGSPRAHRSSNGSLSHMVHVSSIDLGVVPESTNPRSPKAVTDQLPDPPAQMLSPRDREARVLRYREKKKMRKFEKTIRYASRKAYAEKRPRIKGRFAKRNEVDAEANEAFSTIITFDTGYGIVPSF

SEQ ID NO: 349 - protein, 400 aa, Arabidopsis lyrata subsp. lyrata
MGGSTRESVVACEFCGERTAVLFCRADTAKLCLPCDQHVHSANLLSRKHVRSQICDNCSKEPVAVRCFTDNLVLCQDCDWDVHGSCSSSATHERSAVEGFSGCPSVLELAAVWGIDLEGKKKEDEEDQLTKNFGMALDSWGSGSNSGQDLIVPYDVSIKKQSFSLGRSKKVVFKQLELLKRGFVGGDGGGEIMVPERINGGGSICQPSPMSAESQSHCGNAMQWNATNHSSTLPIIAIWDFNLGQSRNPEEPSPVETKGSTFTFNEVTHVKNDTRATNVKAFKETYQQDDSIRSTSTKGQETSKSNNIPAAIHSHKSSNDSSDLHCMEHIAMTSNRATRLVAATNADLERLAQNRDNAMQRYKEKKKTRRYDKTIRYETRKARAETRLRVKGRFVKATDP

SEQ ID NO: 350 - protein, 366 aa, Arabidopsis lyrata subsp. lyrata
MGYMCDFCGEQRSMVYCRSDAACLCLSCDRSVHSANALSKRHSRTLVCERCNAQPATVRCVEERVSLCQNCDWSGHNNNSSSSSTSPQQHKRQTISCYSGCPSSSELASIWSFCLDLAGQSICEQEMGMMNIDDDGPTDNKNCNEDKKDVFVSIPETSSAAKGKSSSAKDVGVCEDDFYGNLGMDEVDMALENYEELFGTAFNPSEELFGHGGIDSLFQKHQTKAPEGGNSVHPAGSNDSFMSSKTEPIICYTSKPAQSNISFSGVTGESSAGDFQECGASSSIQLSGEPPWYPPTSQENNACSHSVTRNNAVMRYKEKKKARKFDKRVRYASRKARADVRRRVKGRFVKAGEAYDYDPLTPTRSY

SEQ ID NO: 351 - protein, 377 aa, Arabidopsis lyrata subsp. lyrata
MEPKCDHCATSQAVIYCKSDLAKLCQNCDFHVHSANPLSHRHSRSLICQKCFSQPAVIRCLGEKVSYCQRCHWHASNCSDLGHRVQRLNPFSGCPSPTDFVKMWSSILEPSVSSLVSPFVGSLPLNDPNNTMFGMAKINELDGLIGSPYSMVPHSFNVTQNFSDQLSFFSVESKGYPDLVLKLEEGEEDLCEGLNFDNAPLNFDVGDDIIGCSLEEPIEPDHTVPNCLLIDKNNTSVTASNFTIDNTSASSPGQQMNINTGLPLPLSPVLFGQIHPSLNISNVTGESNAADYQDCGMPPGFITSEAPWESNLEVSCPQARTQAKLRYMEKKLKRSFGKQIRYASRKARADTRKRVKGRFVKAGDNYDYDPSSPTTNN

SEQ ID NO: 352 - protein, 347 aa, Arabidopsis lyrata subsp. lyrata
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAASETDADNDEDDREVASWLLPNPGKNSGNQNNGFLFGVEYLDLVDYSSSMDNQFEDHQYSHYQRSFGGDGVVPLQVEESTSHLQQSQHNFQLGINYGFSSGANYNNNFLKDLNHSASVSSMDISVVPESTASDITVQHPRTTKETTDQLAGPPTQVVQQLTPMEREARVLRYREKKKTRKFDKTIRYASRKAYAEIRPRIKGRFAKRIEIEAEAEEIFSTSLMSETGYGIVPSF

SEQ ID NO: 353 - protein, 391 aa, Arabidopsis lyrata subsp. lyrata
MVVDVERRAASVPGGKMVARGCDACMKRSRASWYCPADDAFLCQSCDSSIHSANHLAKRHERVRLQSSSWTETTEKTTSVWYEGFRRKARTPRNKGLASEKLLQMEANDPLVPDLGGEEEEVFFSFSSVEENEESLNCCVPVFDPFSDMVIDDINGFCLVPDEVINNTTNGEELGELEREVIDDEGFIGFLPLDMDLEDLTMDVERLLKEGQLCLGLKEPNDIGVIKEENNVGFEIDCKDLKRVKDEEEEEAKCENGRSKDSDGEASKDEDRKTSLFLSLDYEAVITAWDNHGSPWKTGIKSECLLGGNTCPSHAVGGFDELVSTVGSVTRQQVKDGGGSDGEREARVLRYKEKRRTRLFSKKIRYEVRKLNAEQRPRIKGRFVKRTSLLT

SEQ ID NO: 354 - protein, 412 aa, Arabidopsis lyrata subsp. lyrata
MMKSLASAVGGKTARACDSCVKRRARWYCAADDAFLCHACDGSVHSANPLARRHERVRLKSASSGKHRHASSSSPSHQSTWHQGFTRKARTPRGGKKSHTMVFHDLVPEMSTENQAESYEVEVEEQLIFEVPVMNPMVKEQCFHQSVETKVEFPMMPLSFKCSDEEDEDNAESCLNGLFPTDMELAQFTADVETLLGGGMEREFHSIEELGLGEVLKIEKEEVEEEEGVVTREVYDLDEAEETSPFEISFDYEYAHKTTYEEEEEDEKEDVMKNRMDVGVNEMSGRIKEENKEKALMLRLDYESVISTWNGQGIPWTDREPSEIDLDMVCCPTHSLGESGEAHHHNHFRGLGLHMGEAGDGGREARVSRYREKRRTRLFSKKIRYEVRKLNAEKRPRMKGRFVKRSSIGVAL

SEQ ID NO: 355 - protein, 419 aa, Arabidopsis lyrata subsp. lyrata
MKSLANAVGAKTARACDSCVKRRARWYCAADDAFLCQSCDSLVHSANPLARRHERVRLKTASPAVVKHSNHSSSSPPHEAATWHHGFTRKARTPRGSGKKNNSSIFHDLVPEISVEDQTDSYELEEQLICQVPVLDPLVAEQFLNDVVEPKIEFPMMRSGVMIEEEEDNAESCLNGFFPTDMELEEFAADVETLLGRGLDSESYPMEELGLSNSEMFKLEKDEIEEEVEERKAMNMEIFDDDRRDGDGTVPFELSFDYESSHKTSKEEVMKNVESSGECVVKVKEEEQKNVLLLRLNYDSVISTWGGQGPPWSSGVPPERDMDISGWPAVSMGENGGECTHKKQYVGGCLPSSGFGDGGREARVSRYREKRRTRLFSKKIRYEVRKLNAEKRPRMKGRFVKRASLAASAAAISPLGVNY

SEQ ID NO: 356 - protein, 326 aa, Arabidopsis lyrata subsp. lyrata
MIWENQTDVKQQRACELCKNKHAVWYCASDDAFLCHVCDESVHSANHVATKHERVCLRTNEISNYVLRGTTSNPVWHSGFRRKARTPRVRCEKKPQEKIDDERRIEDPRVPEIGGEVMFFIPEPNDDDMTSLVPEFEGFTEMGFFLNNHNGTEETTKQFNFEDEIDAKEDLCYNGEDEEEVKTDGAEACPEQYLMSCKKDYDNVITVSAKTEEIEDCYENKARQRNMLLKLNYENVIAAWDKQESPINQTEFNNTSNLQLVPPLQGIEEKRVSNRSEREARVWRYRDKRKNRLFEKKIRYEVRKVNADKRPRIKGRFVRRSLAMDS

SEQ ID NO: 357 - protein, 438 aa, Vitis vinifera
MADTCLAPHLGAEFAFTSVARNMESDACHSKGFSTTPTCLFRLPTVTSSPPFVHCAPETQTYAHSHSLTHMLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPVLPIAGCLYGPPATDPGGTEDEDEAASWLLLNPVKNNNGSSNNQNNGLLFGGEVDEYLDLVEYNSCPENQFSDQYNQQQPPPHYSVPHKNYGGDRVVPVQCGEAKGQLHQQHQQQGFHLGMEYESSKAAYSYNPSISHSVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 358 - protein, 342 aa, Brassica rapa
MGYMCDFCGEQRSMVYCRSDAACLCLSCDRSVHSANALSKRHSRTLVCERCNSQPATVRCVEERVSLCQNCDWSSHNNNNNSSSSSNNHKRQTISCYSGCPSSSELASIWSFCLDLAGQSGCEQEMGMMNIDGDGQNNQNCNEEKKDVVAGSSSRPETSSAAPATSAFPKDVRVCEDDFYGNLGMDEVDLALENYEELFGTAFNTSGELFGQGGIDCLFQKHHQGAAPEGGNLVQPAESNDDSFMSSKTEPIICFTSKPAHSNISFSGVTGDSSAGDFQECGASSSMQLSGEPPWYPQTSQDNNASSHSVTRNNAVMRYKEKEKARKFDKTVRYASRKQELM

SEQ ID NO: 359 - protein, 484 aa, Malus x domestica
MVSPKSGGVEGVPCDFCSDQPAVLYCRADSAKLCLFCDQHVHSANLLSRKHVRSQICDNCSSEAVSVRCSTDNLVLCQECDWDAHGSCSVTAAHDRTPLEGFSGCPSALELASLLGLDLQDKNLPARPDPQLQNWDMGLPSVDPSWNGFGMQDLMVPIQNGVVDLTGDMKRQNSGGISGKQKQGIQKQLLELLKRDLGGGRGGGGSGSENLVPGTQTRNGWQEENGKGNGDVEGLASIDVRNENGGVGGVAARAASLETVLQQQTPFSTMLMMPEENRDGDMLWDSNPHGQTQIWDFNLGRLRDHEESGPLKVTYGSNVSGFMIKDFSELMKESSLTDTKMLRDIYQMNSPVGHDDIKFNITSNNPEGSLGPATSESNNVPIGQPLSGSVFGDDKGSGASNDISFMEQSFLMRGDSISMRTVGTKADMELLAQNRGNAMLRYKEKKKTRRYDKHIRYESRKARADTRKRVKGRFVKATTESPDG

SEQ ID NO: 360 - protein, 364 aa, Malus x domestica
MCEVCDQAPAAVTCKADAAALCVACDADIHSANPLARRHERVPVEPFYDSAESIIVKSTAAAPSSAGAAINYLVPNGDVLSKTKDVNNDPASNWLIPNPNFNSKLQMDIAPDITKSSGDLFFPEMDLLLELDYPNSIHTISGPGTDGVVPVQTDPIPPPSLKMNHNISGPADQNCFDMDFCSSKFSSSFSYPTQSLSQSVSSFSLDVGVVPDQNSLSDISYTFGRTACNGVSEPGDVSYSFGQKASNNVSEPGDISYPFGRKASNNVSEPGAPVSATPASQPATQLCGLNREARVLRYREKRKNRKFQKTIRYASRKAYAETRPRIKGRFAKRTKTETETFDLIYGSGSATFISDPQFGVVPTF

SEQ ID NO: 361 - protein, 393 aa, Malus x domestica
MLKEDQSNGTATANNWARVCDTCRAAACTVYCRADSAYLCSGCDATIHAANRVASRHERVWVCEACERAPAAFLCKADAASLCTACDADIHSANPLARRHQRVPILPISGCLYSSQATEQGEMGVAVSAGAETEDGFLSQEGDDTIYEEDEDEAASWLLLNPVKNNNNNNNTNTQNNGFFFGAEVDEYLDLVEYNTCADQNNQFTDHHQQHDQQQQQQYGVPYKNYGGDSVVPIHQHGEVGKAHQLQKQSFHQLGLEYESSKAAYSYNGSLSHSVSVSSMDVGVVPDSTMSDISISHPRTPKGTIDLFSGPTIQMPTQLSPMDREARVLRYREKKKTRKFEKTIRYASRKAYAETRPRIKGRFAKRTEMEVEVDQMFATSLMAENGYGIVPSF

SEQ ID NO: 362 - protein, 409 aa, Malus x domestica
MGYMCDYCQVQRSMVHCRSDAACLCLSCDRNVHSANALSRRHLRTLICERCNSQPALVRCTEERVSLCQNCDWMGHQASTSASGHKRQTLNCYSGCPSSAELSSIWSFVSDLPSNGESACEQEMGLMSIAENSTRSEWSQTESNTRQSASGADEVNPAHSMEKSGILVGSSSVPERSHARHVVGQLSGSVNASLPKLYSHGGKGTGLPEDDDLYDDLDMDEMELNLENYDELFGVSLNHSEELFKNGGIDSLFGAKNVSRDCQDAVAAEGSSFGLGNAPQPACSNAASADSVMSTKTDPVICFPAKQAHSNLSFSGITGESSAGDCQDCGASSTPWYPPCPESSMQSANRSNAVMRYKEKKKARKFEKRVRYASRKARADVRKRVKGRFIKAGEAYDYDPLNQARTRSY

SEQ ID NO: 363 - protein, 448 aa, Selaginella moellendorffii
MEKASSTSKSSSNLAATAMAIAGRALRPCDVCGRERAKWFCKADEAYLCENCDGSVHGANAVSLRHERFRMGPNGMLMKNVKRVSKFQLAEDISPTNSAAAVTAACAKDSHCPPRKKPRSSRSHSLGSNSSKESGKVKAEPKSPKEYAAEFQPCQESSHEVPIFDPLLEDFAASDDNSLGCTVPCATPPDEDDEEMCFTVPDDCDLDGFLDSEADLGVMDGIISGTIEMDGIADLGDVLGESECKTFTHDSFGIDFPAIFHSPSPNSDGSVADAFDSADAVKVKTEEAEELDKIKLEVDEMLGFAFSSASTVKEEEVEKKITLKLDYEDVLNAWSDRGPFWTEGPRPQTVPDDSLFDPASTLDYGLVPDFCMESTEVEAVGQVPVVNFGEDRLTPQGGREARVMRYREKRRTRLFSKKIRYEVRKLNAERRPRLKGRFVKRTNSTPHA

SEQ ID NO: 364 - protein, 287 aa, Selaginella moellendorffii
MAKRPNCDVCEMQRASLYCEADEAYLCHECDASVHGANTLASRHKRISFKQEQEEEEEEENLEENDGVCPAHNFADSSFSLSRPSTVDYPLGGVRIGDVTYARVSSHTGSGGASLIAPRRKEDEELHQVPRFVPVAQELPSLEPFRFHALASNGRASPVRSTRFMSLLEGEATDADENHGAPDEDGAQENQELGVVPDLVSPRTVEPAAAKPVAALPKGGPRLDKEREARVNRYREKRRTRMFSKKIRYEVRKIYAENRPRLKGRFVRRTNEIESLQCLWSEDQVRN

SEQ ID NO: 365 - protein, 448 aa, Selaginella moellendorffii
MEKASSTSKSSSNLAATAMAIAGRALRPCDVCGRERAKWFCKADEAYLCENCDGSVHGANAVSLRHERFRMGPNGMLMKNVKRVSKFQLAEDISPTNSAAAVTAACAKDSHCPPRKKPRSSRSHSLGSNSSKESGKVKAEPKSPKEYAAEFQPCQESSHEVPIFDPLLEDFAASDDNSLGCTVPCATPPDEDDEEMCFTVPDDCDLDGFLDSEADLGVMDGIISGTIEMDGIADLGDVLGESECKTFTHDSFGIDFPEIFHSPSPNSDVSDADAFDSADAVKVKTEEVEELDKIKLEVDEMLGFAFSSASTVKEEEVEKKITLKLDYEDVLNAWSDRGPFWTEGPRPQTVPDDSLFDPASTLDYGLVPDFCMESTEVEAVGQVPVVNFGEDRLTPRGGREARVMRYREKRRTRLFSKKIRYEVRKLNAERRPRLKGRFVKRTNSTPHA

SEQ ID NO: 366 - protein, 452 aa, Selaginella moellendorffii
MERPCDFCGDERATVYCKADAALLCLSCDRNVHDANALSRRHSRTLVCDMCVVQPAVVRCGAESKAFCQACDGKRHAEYRAMHHKRRAIVSYTGCPSSAELARLWYCDVSDEPGGNGSGNGSGKGSTSKCLETFQGWVPASSQSQQQLHHPSTPQSREKKIFQQLMILQNRPPQQGLGHQQREKAITQAQTLMPPPPPRPSTSSSNGVAEIQYQTAQLGLHSPSSKPESGEIFPQQGENAWKAASPDQQLWNNAQDMGIDDICKALTADDVNVFDNYEDLFLSAQDAAGTPFQDIGIACPSMAPAMSSKSMQNGCSSMDTANSLQSDASESACRGPFHPAAAAGNVQFSPRPACSSGVSGDSSGTEYADCASVFYSAGELWSSTSSDPAAASEARGNAMLRYKEKRKTRKYEKRIRYESRKTRADTRRRIKGRFVKAGQVYDYDPLSTTRSY

SEQ ID NO: 367 - protein, 363 aa, Selaginella moellendorffii
MTKPCDACQSGNAVIYCRADAAFLCCSCDNKVHCANKLASRHERVLVCEVCEHAPAAVTCKADAAALCVTCDSDIHSANPLARRHERVPITPFVDSSDGGAAPPPAPPILHDTGNANHDDEEESSAAEAASWLLPQPNNLAKSDGEKLGGGVESTDFYSTLKPSAPPPLRIEKLLLKSQAAANFDLFSDEDSYLDMDFLGALHSVTDSLVPIHTTGGALHSSSPVGSNADSYDLDVHDKSPPHAYCPGLSLSASSIDVGVVPDASLSDISTPQSRPTSSSVFGSGEAQAAAAPLHHATPLEPIAREARVLRYREKRKNRKFEKTIRYASRKAYAETRPRIKGRFAKRGEMDSYDASFGVVPSF

SEQ ID NO: 368 - protein, 453 aa, Selaginella moellendorffii
MERPCDFCGDERATVYCKADAALLCLSCDRNVHEANALSRRHSRTLVCDMCVVQPAVVRCGAESKAFCQACDGKRHAEYRAMHHKRRAIVSYTGCPSSAELARLWYCDVSDEPGSGSGSGNGSGKGSTSKSLETLQGWLPASSQSQQQLHHPSTPQSREKKIFQQLMILQSRPPQQALGHQQREKAITQAQTLMPPPPPRPSTSSSSGVAEIQNQTAQLGLHSPSSKPESGEIFPQQGENAWKAASPDQQLWNNAQDMGIDDICKALTADDVNVFDNYEDLFLSAQDAAGTPFQDIGIACPSMAPAMSSKSMQNGCSSMDTANSLQSDASESACRGPFHPAAAAGNVQFSPRPACSSGVSGDSSGTEYADCASVFYAAGELWSSTSSDPAAASEARGNAMLRYKEKRKTRKYEKRIRYESRKTRADTRRRIKGRFVKAGQVYDYDPLSTTRSY

SEQ ID NO: 369 - protein, 405 aa, Volvox carteri f. nagariensis
MACVVCAAQASVYCENDKALLCKDCDVRIHMSNAVAARHVRRIPCEGGCSKGASLFCRCDNAYMCEACHCANPLAATHETEPTAPLPLMEQENAVAEQPHATGPCESVAQSAASPVAWFVDDEKPSLGSFEEPIMLSPAGSEAVVPVMSAPADDFTFTEPATFKEIKDKLEFESLEFDNSWMELNFDFTDILSDGPSDVGLVPTFDLEGVDPVADATVPSVAEEVVVAESDAATEIHRKRTAEPSDEEPAAKLPAISEAATTALGLHAAFQMTQPASLFFQSAVAQPSLLPPMVPPAVISPLATTAAAPPLQPPPTAVQSKSSAAYNTALAAGANLTREQRVARYREKRKNRKFEKTIRYASRKAYAEIRPRIKGRFAKKEEIEAWKAAHGGEDAVVPEILDGEF

SEQ ID NO: 370 - protein, 402 aa, Arabidopsis thaliana
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 371 - protein, 417 aa, Arabidopsis thaliana
MMKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 372 - protein, 406 aa, Arabidopsis thaliana
MDPTWIDSLTRSCEANSNTNHKRKRERETLKHREKKKKRFRERKMASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFTYGGGYNCISHSVSSSSMEVGVVPDGGSVADVSYPYGGPATSGADPGTQRAVPLTSAEREARVMRYREKRKNRKFEKTIRYASRKAYAEMRPRIKGRFAKRTDTNESNDVVGHGGIFSGFGLVPTF

SEQ ID NO: 373 - protein, 326 aa, Arabidopsis thaliana
MTSHQNIKISEKIMISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 374 - protein, 385 aa, Helianthus annuus
MLDHTGTLCLKTSTTWARVCDTCRSAPCTIYCRPDAAYLCTACDARIHAANKLQSSQHERVWVCEACEQAPAAFICKADAASLCTTCDADIHSANPLARRHHRVPVMPIPGALYGPQGAGPDPRAVMGLGVGVDSQSGFLSNDGGGDEEDESEAASWLLFDGPVVVNKNSQSQSGGGGKDSGFLFSGEGGEEDEYLEFMEFGSDVQAQCYANKVNDQKMSYADADSVVPVQKNHEFQNHKFQLGVDYEGAAAGATGGYGYPQLTHSVSMSSMEVGVVPDSTITEASFSHPRPSKGTIDLFSNPPVQVATQLTPMDREARVLRYREKKKTRKFEKTIRYASRKAYAETRPRIKGRFAKRTNADVDVDQMFPTNHMLEGGYGIVPSF

SEQ ID NO: 375 - protein, 385 aa, Helianthus annuus
  misc_feature (246)..(246): Xaa can be any naturally occurring amino acid
  misc_feature (337)..(337): Xaa can be any naturally occurring amino acid
  misc_feature (361)..(361): Xaa can be any naturally occurring amino acid
MLDHTGTLCLKTSTTWARVCDTCRSAPCTIYCRPDAAYLCTACDARIHAANKLQSSQHERVWVCEACEQAPAAFICKADAASLCTTCDADIHSANPLARRHHRVPVMPIPGALYGPQGAGPDPRAVMGLGVGVDSQSGFLSNDGGGDEEDESEAASWLLFDGPVVVNKNSQSQSGGGGKDSGFLFSGEGGEEDEYLEFMEFGSDVQAQCYANKVNDQKMSYADADSVVPVQKNHEFQNHKFQLGVXYEGAAAGATGGYGYPQLTHSVSMSSMEVGVVPDSTITEASLSHSRPSKGTIDLFSNPPVQVATQLTPMDREARVLRYREKKKTRKFEKTIXYASRKAYAETRPRIKGRFAKRTNXDVDVDQMFPTNHMLEGGYGIVPSF

SEQ ID NO: 376 - protein, 388 aa, Helianthus annuus
MLNEDLTSTLCLKNSTTRARLCDTCHLLPGTIFCEADLAYLCTACDLHVHAANKLSSRHKRVRVCDACEQAPAAFICKADAASLCTTCDAVIHSANPLSRRHHRVPVMPILGSSVYNNNNNNEPWSVIGLGFQPQDSADQATLDHHNHHQDEDEAASWLIFHDSPPKNNGQGQSQTNEFVSNGDEYLELVDYNSCQDTPFSDDLKFDDDNKYMHDGINNNIQQQQRYGGCDADSLVPGQKYHQLQHQHNFQNQKFQLGMDYETSNGGYGYSASLGDSVSMSSMEVGIAVDSTITEASIDLFSNPSIQMPTQLTPIDREARVLRYREKKKTRKFEKTIRYASRKAYAETRPRIQGRFAKRTNLDIDIEVDQMFSTSLITQDGSCTFPSF

SEQ ID NO: 377 - protein, 386 aa, Helianthus annuus
  misc_feature (213)..(213): Xaa can be any naturally occurring amino acid
MLNEDLTSTLCLKNSTTRARLCDTCHLLPGTIFCEADLAYLCTACDLHVHAANKLSSRHKRVRVCDACEQAPAAFICKADAASLCTTCDAVIHSANPLSRRHHRVPVMPILGSSVYNNNNNNNNEPWSVIGLGFQPQDSADQATLDHHNHHQDEDEAASWLIFHDSPPKNNGHGQSQTNEFVSNGDEYLELVDYNSCQDTPFSDDLKFDDDNXYIQQQQQQQQRYGGCDADSLVPGQKYHQLQHQHNFQNQKFQLGMDYETSNGGYGYSASLGDSVSMSSMEVGIAVDSTITEASIDLFSNPSIQMPTQLTPIDREARVLRYREKKKTRKFEKTIRYASRKAYAETRPRIQGRFAKRTNLDIDIEVDQMFSTSLITQDGSCTFPSF

SEQ ID NO: 378 - protein, 337 aa, Brassica napus
MLKQEGNWAQTCDTCRSAACTVYCRADSAYLCTSCDAQIHAANRLASRHERVRVCQSCERAPAAFFCKADAASLYTACDSQIHSANPLARRHQRVPILPISGSMVTNRSSETTEAEDIVVVGQEEEDEAEAASWLLPTSVKNCGDNNNNNNNSQDNRFSVGEEYLDLVDYSKYQQDYNVPQRRSYVADGVVPLQVEVSKSLSHMHHEQHNFQFGFTNVSSEASPIHMVSLVPESTLSETTVSNPRSPKAATEELPEAPVQMLSPMERKARVMRYREKKKTRKFEKTIRYASRKEYAEKRPRIKGRFAKRNEVDAEEADKAFSSMVMFDTGYGIVPSF

SEQ ID NO: 379 - protein, 369 aa, Triticum aestivum
MFMNCNFNSNLLENEAGRISFPWARPCDGCHAAPSAVYCCADAAYLCASCDTQVHSANRVASRHERVRVCETCESAPAVLACHADAAALCTACDAQVHSANPIAQRHQRVPVLPLPAVAIPAASGFAEAEASVTAHGDKEEGEEVDSWRLRRNSDDNNCANKIDRYYNLVGYNMYYNNITCDPRPEEQYRMQEQRVQNRYIEKQGCECVVPPQVVMASEQQESDYGTRGAGQAASVTAITSTYTASISNDISFSSMEVGIIPDNTRPDISNSNILTGSEAMELSGHSLQMPVHFSSMDREARVLRYKEKKQTRKFQKTIRYATRKAYAEARPRIKGRFAKRSDIEHEEDHMLSPPALPDTSSYNTVPWF

SEQ ID NO: 380 - protein, 370 aa, Triticum aestivum
MFMNCNFNSNLLEKEAGRTSFPWARPCDGCHAAPSAVYCCADAAYLCASCDTQVHSANRVASRHERVRVCETCESAPAVLACHADAAALCTACDAQVHSANPIAQRHQRVPVLPLPAVALPAASGFVEAEASVTAHGDKEEGEEVDSWLLRRNSDDNNCANKIDRYFNLVGYNMYYDNITCDPRPEEQYRMQEQQHVQNRYIEKEGCECVVPPQVVMASEQQESDYGTIGAGQAASVTAMTSTYTASISNDISFSSMEVGIVPDNTRPDISNSNILTSSEAMELSGHSLQMPVHFNSMDREARVLRYKEKKQTRKFQKTIRYATRKAYAEARPRIKGRFAKRSDIEHEEDHMLSPPALQDTSSYNTAPWF

SEQ ID NO: 381 - protein, 369 aa, Triticum aestivum
MFMNCNFNSNLLENEAGRISFPWARPCDGCHAAPSTVYCCADAAYLCASCDTQVHSANRVASRHERVRVCETCESAPAVLACHADAAALCTACDAQVHSANPIAQRHQRVPVLPLPAVAIPAASGFAEAEASVTAHGDKEEGEEVDSWLLRRNSDDNNCANKIDRYYNLVGYNMYYDNITCDPRPEEQYRMQEQHVQNRYIEKEGCECVVPPQVVMASEQQESDYGTIGAGQAASVTAMTSTYTASISNDISFSSMEVGIVPDNSRPDISNSNILTSSEAMELSGHSLQMPVHFSSMDREARVLRYKEKKQTRKFQKTIRYATRKAYAEARPRIKGRFAKRSDIEHEEDHMLSPPALPDTSSYNTVPWF

SEQ ID NO: 382 - protein, 321 aa, Brassica rapa
MLKEESNESGGTRACDTCRSAACTIYREADSTYLCTTCDARVHAAKRVRVCDSCESAPAAFFCKADAAPLCTACDAEIHSANPLARRHQRVPITSNSCGSMATDGDNNVMMVSEEKEDADEVASWLMLNPGKNNQNNGFLFGVEYLDLVDYSSSIDNQFEDQYNHYQRSFGGGEDGVVPLQLEESTSHMQQSQHNFHLGVNYGFSTEPHYSYISVVPESTSSDTTVQHAKETMDQVSGPPTQMVQQLTPADREARVLRYREKKKRRKFEKTIRYASRKAYAEVRPRIKGRFAKRIDMEADAEQLFSTSLMSNTSYGIVPSF

SEQ ID NO: 383 - protein, 422 aa, Populus deltoides
MPRFTSLILSSPLVFFLQVSLILATNAHSLSYIAKDSIIEIGIGREREEVMLKEESGGSGGVVNNWARVCDTCRAAACTVYCRADSAYLCAGCDARVHAANRVASRHERVRVCEACERAPAALLCKADAASLCTACDADIHSANPLARRHQRVPILPISGYLYGTQVGPAAGETEDQFMTQEGEETIGEEDEDEAASWLLLNPAKNSNNQNNNGFLFGGEVDEYLDIVEYNSCAENQYSDQYNQQHYSVPPKSCGGDSVVPIQYGEGKDHQQQQQQQYHNFQLGLEYEPAKAAYSYDGSVSQGVSMSSMDVGVVPESAMSEISISHQSASRGTIDLFSSPPIQMPSQLSPMEREARVLRYREKKKARKFEKTIRYASRKAYAETRPRIKGRFAKRTDVDVEVDQMFSSTLMAETAYGIVPSF

SEQ ID NO: 384 - protein, 372 aa, Populus deltoides
MLKQESSGSGGGDNRARLCDTCRAAACTVYCRADSAYLCAGCDARVHAANRVASRHERVWVCESCERAPAALLCKADAASLCTACDADIHSANPLARRHQRVPILPISGCLHGSQVGPAAGETEDRFTTQEGEETISEEEEEEEDEAASWLLLNPVKNSKNQNNNGFLFEGEVDEYLDLVEYNSCTENQCSDQYNQQHYCVPPKSYGGDRVVPIQYGEGKDHQQQRQYHNFQLGLEYEPSKAAYSYNGLISQSVSMSSMDVGVVPESTMSEISISQHRTPKRTIELFSSTAIQMPSQLSPMDREARVLRYREKKKTRKFEKTIRYASRKAYAETRPRVKGRFAKRKDVEVEDDRTFSSTLMAGTGCGIVPSF

SEQ ID NO: 385 - protein, 401 aa, Arabidopsis thaliana
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 386 - protein, 391 aa, Solanum lycopersicum
MLKKENSNNWARVCDSCHSATCTVYCRADSAYLCAGCDARIHTASLMASRHERVWVCEACERAPAAFLCKADAASLCASCDADIHSANPLARRHHRVPIMPIPGTIYGPPAVHTITGGSMMIGGTTGEGTEDDGFLSLNQDADDTTIDEEDEDEAASWLLLNPPVKNNNKNNNYGMLFGGEVVDDYLDLAEYGGDSQFNDQYSVNQQQQHYSVPQKSYVEDSVVPVQNGQRKSLILYQTPQQQQSHHLNFQLGMEYDNSNTGYGYPASLSHSVSISSMDVSVVPESAQSETSNSHPRPPKGTIDLFSGPPIQIPPQLTPMDREARVLRYREKKKNRKFEKTIRYASRKAYAETRPRIKGRFAKRTDVEAEVDQMFSTQLMTDSNYGIVPSF

SEQ ID NO: 387 - protein, 438 aa, Pinus radiata
MVLENFGGVGAREASCRIRHELRGIGGWRMSMPKLCDVCQVSSSVIYCRAHTAQLCLVCDAKIHGGSKASLCHERVWVCEVCEQAPAVVTCKADAAALCVACDTDIHSANPLASRHERAPVIPFYECPNMPTNNTVTHANNDNLDCNVLLNEDGGGDDPLKHDYVDDDYGDYDDDENDQNNLLNNQEDNNDAEICCAEEAATASWLIPEANRNNLTIINGGNSEGEDKMVKDKLKFKAYMQSMDFLQDVDNYADLEYLGTTTITTPINPTANMGADSMVPVHTPEVIEHSSTKVSIDTAGSMDVDAASKCNHVYRTTSLNHCVSSSPIDVGIVPDSNITSDISTPYHDPRGVFEIPPRVVHPGGQGEVMGREARVLRYREKRKNRRFEKTIRYASRKAYAETRPRIKGRFAKRTEVEVEQIYSSSLLPDQGYGVVPSY

SEQ ID NO: 388 - protein, 452 aa, Oryza sativa Japonica Group
MSCSSEKAAGAVGGKAARACDSCLRRRARWYCAADDAFLCQGCDTSVHSANPLARRHERLRLRVSSPPPLTARASVEEEAAAAVGTTTTTTSKREGGVTPAWSKRKARTRRPQVKSVGQLLSRRLVVPEMAVESSDERKADEDGAHEELEGQLLYRVPVFDPSLAEFCSPPPIDDAAAASSSCFKEDAADGAVEDAKYPAAAASSPVQQLPDSFVNFEPTDAELREFAADMEALLGQGLDDSNELQDSFYMETLGLITPPVEESGRVKMELDGGVASNSRVSLPSCRAHPKPEDVESADVLDIDFNCTSPDEQKSSASNGAAADSQFFHRSLDLRLNYEAIIESWGNSPWTDGRPPHGQLDDFWPNDHHYSGLWAAGGGGHGAEVGMMTVRPRMDGPGREARVTRYREKRRTRLFSKKIRYEVRKLNAEKRPRMKGRFVKRPSAAAAPCAVT

SEQ ID NO: 389 - protein, 362 aa, Arabidopsis thaliana
MASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFTYGGGYNCISHSVSSSSMEVGVVPDGGSVADVSYPYGGPATSGADPGTQRAVPLTSAEREARVMRYREKRKNRKFEKTIRYASRKAYAEMRPRIKGRFAKRTDTNESNDVVGHGGIFSGFGLVPTF

SEQ ID NO: 390 - protein, 405 aa, Pisum sativum
MLEQKFLTTTSATVRSAVTWPRTCDTCRSAPCAVFCRADSAYLCAGCDARIHAANRVASRHERVWVCEACERAPAAFLCKADAASLCSSCDADIHSANPLASRHQRVPILPISGYLYGPPTTLLGADDEGFVRGGGDAEEEEDEGADMEDENEAASWLLLNPLKNNHHNINNHNNNNNSNDHNQEGNNNGFLFSGEVDEYLDLVDCNSCGGGENTFTTNNTHDHDYSRDQQQQRQDHYGVPQKNYVGDSVVPVQQQHLQNFQLGLEFESSKAGFSYNGASISQSVSVSSMDVGVVPESTMRDATTMSYSRPSKGTIDLFSAPPIQMTSHFSPMDREARVLRYLEKKKTRKFEKTIRYASRKAYAETRPRIKGRFAKRTDVEAEVDQMFSTTLITEVGYGIVPSFV

SEQ ID NO: 391 - protein, 368 aa, Physcomitrella patens
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSLVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRCKEKRQKRKFEKTIRYASRKAYAESRPRIKGRFTKRTDSDVEQMFSSCTADSGFGVVPSSC

SEQ ID NO: 392 - protein, 407 aa, Oryza sativa Indica Group
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNKDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 393 - protein, 319 aa, Arabidopsis thaliana
MFCAEIMISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 394 - protein, 348 aa, Glycine max
MLDGEATMGTWARMCDTCRSAPSSVFCRAHTAFLCATCDARLHASLTWHERVWVCEACERAPAAFLCKADAASLCASCDADIHAANPLASRHHRVPILPIAAAPGNNDNDNVDDADLDDDDETASWLLLNPVKSASVPNNNNTNNGFSYNGEVDEYLDLVDDCDNHHFASVATTTDHYSHQHQHFGVVSHKSYAGDSVVPVQHHQHFQLGLEFDNSKAAFSYNASVNQSVSVSSMDIGVVPESPMRDVSIGHTRTPKGTIDLFSGPPIQVPSHFSPMDREARVLRYREKKKTRKFEKTIRYASRKAYAETRPRIKGRFAKRTDVEAEVDQMFSTTLITEVGYGIVPSF

SEQ ID NO: 395 - protein, 328 aa, Glycine max
MLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNAAATTDHYAQHQHFAGVSQKSYAGDSVVPVQQHQHFQLGLDFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 396 - protein, 352 aa, Glycine max
MLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNGEVDEYLDLVDNCNSCGDNNHFASAAATTDHYAQHQHFAGVSQKSYAGDSVVPVQQHQHFQLGLDFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 397 - protein, 381 aa, Cleome spinosa
MLKEERTSGGETGENNWARICDTCRSAACTVYCRADSAYLCTSCDARVHAANHVASRHERVWVCESCERAPAAFLCKADAASLCAACDAEIHSANPLARRHHRVPILPISGSMSGPMANHHPSETAMTDTENDMVVGREEAEDEDEDDEEAASWLLLNPGKNSGNNNNQNNGFFFDGEADEYLDLVEYNSSMENQFSDQYSQYHQDCGVPQKSFGGDGVVPLQVEESRGQLHHEQQSFQLAITYGSPGALYGSYNGSMNHSVSMSSMDIVVVPESTASDMAVVSQLRAPKGTTDLLIGPPIQMMPQLSPMDREARVLRYREKKKTRKFEKTIRYASRKAYAETRPRIKGRFAKRTDIEAEVDQAFSTTLMQESGYGIVPSF

SEQ ID NO: 398 - protein, 317 aa, Medicago sativa
MATKLCDSCKSSKATLFCRSDSAFLCLTCDSNIHAANKLASRHHRVTLCQVCEQAPAHVTCKADAAALCISCDHDIHSANPLARRHERVPLTTFHHHNNNSQQQSFFSENDHDATNEEAGAASWLLQTPSNPKFPDLNYSHYSYPEIDDFVTVNAKTDTPEQNSPGTTADGVVPVQSQSKTTTEHQHEHYSDINIDFSNSKPFTYNFNHTVSSPSMEVGVVPDGNVMTEISYCGYQTTATETAPMTVAVPMTAVEREARVSRYREKRKNRKFEKTIRYASRKAYAETRPRIKGRFAKRSDLNMNLIAEDEYGVVPSC

SEQ ID NO: 399 - protein, 332 aa, Oryza sativa Japonica Group
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 400 - protein, 333 aa, Oryza sativa Japonica Group
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADADGEDEEMYSSAAAAVAALMAPGGSDADYGVDGVVPTF

SEQ ID NO: 401 - protein, 331 aa, Oryza sativa Indica Group
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADGEDEEMYSSAAAAVAALMAPGGSDADYGVDGVVPTF

SEQ ID NO: 402 - protein, 384 aa, Picea sitchensis
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDHDDDDEIYAAEAASWLLPNPKSSAEGTKNCDDGGSCFGVDAGPPVNKAAGGYFSVVDLFPDVDPYLDLDYASPLEATGGTDSVVPVQSNVSSQDGAVSTPSDCFDTEKVTYSYTTTTSLSHSVSSSSLDVGVVPDATLSDMPRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 403 - protein, 350 aa, Populus trichocarpa x Populus deltoides
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGAAVNLLEDRYFDEVDGGRGDVSREEAEAESWLLPNPGGGTAKGVDSMDLNTGQYVFGSEMDPYLDLDPYVDPKVEVQEQNSSGTTDGVVPVQSNKLGFQAPALVNDNCCYELDFSTGSKSFGGGYGYNSLSHSVSSSSLDVGVVPDGSGSTLTDISNPYCSRSVSNGMESANQTVQLSAVDREARVLRYREKRKNRKFEKTIRYASRKAYAETRPRIKGRFAKRTDTEVEVDRSSLYGFGVVPSF

SEQ ID NO: 404 - protein, 332 aa, Oryza sativa Indica Group
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFTFSQAAADAAGAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGAAAPPMVVVVASKGKEREARLMRYREKRKNRRFDKTIRYASRKAYAETRPRIKGRFAKRTADADDDDEAPCSPAFSALAASDGVVPSF

SEQ ID NO: 405 - protein, 384 aa, Picea abies
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDDDEDDEIYAAEAASWLLPNPKSSAEGAKNCDDGGSCFGVDAGPPVNKAAGGYFSVVDLFPDVDPYLDLDYASPLEATGGTDSVVPVQSNVSSQDGAVSTPSDCFDTEKATYSYTTTTSLSHSVSSSSLDVGVVPDATLSDMSRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 406 - protein, 294 aa, Arabidopsis thaliana
MASSSRLCDSCKSTAATLFCRADAAFLCGDCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYGGFGVVPSF

SEQ ID NO: 407 - protein, 362 aa, Chenopodium rubrum
MMKKEVPGGDNNSWARVCDTCRSAPCTVYCKEDSAFLCTSCDARIHAVNQMASRHERVWVCEACEREPAAFLCKADAASLCATCDADIHSANPLARRHHRVPIMPVGCVYGPSDGRMSEDGFLDLPDRDDQTTDHEGDEDEAASWLLLNPGKNSNNQTTNGFLTGGGEVDEYLDLFEYNSGADNQFCEQYNQQQEFSVPEKNCGGDSVVPVQCREVKDHQIQYQNFLFGMECETKSEYTYNTSISHSVSVSSLDVGVVPESTMSDMSVSHSRPPKGTIDLFSSTPMQVPTQLSPLDREARVMRYREKKKNRKFEKTIRYASRKAYAETRPRIKGRFAKRTDVEAERTNSLMSDGGYGIVPSF

SEQ ID NO: 408 - protein, 336 aa, Chenopodium rubrum
MMKKEVPGGDNNSWARVCDTCRSAPCTVYCKEDSAFLCTSCDARIHAVNQVASRHERVWVCEACEREPAAFLCKADAASLCATCDADIHSANPLARRHHRVPIMPVGCVYGPSDGRMSEEGFLDLPDGDDQTTDHEGDEDEAASWLLLNPGADNQFCEQYSQQQEFSVPEKNCGGDSVVPVQCREVKDHQIQYQKFLFGMECETKSEYNYNTSISHSVSVSSLDVGVVPESTMSDMSVSHSRPPKGTIDLFSSPPMQVPTQLSPLDREARVMRYREKKKNRKFEKTIRYASRKAYAETRPRIKGRFAKRTDVEAEMDQMFTNSLMSDGGYGIVPSF

SEQ ID NO: 409 - protein, 355 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 410 - protein, 348 aa, Beta vulgaris subsp. vulgaris
MGGGLMAAKLCDSCKSATATIFCRADTAYLCISCDAKIHAANKLASRHARVWVCEVCEHAPATVTCKADAAHLCATCDRDIHSANPLARRHERVPLTPFYDPLSPPNTTNNNNDDSDSSATAAAAAKSAAINKLFGDEYYSDADEAEAASWLLPNPNKTDEPKSIDYLFSSSGNDGDDIDPYLDLDFGAEAKPDPDLSSDGVVPDPDQKGVHHHHLTTLQHPAASMFSLSSYHHHHHHHHVSNNNGHFDGFENSSAACKPFALSSYHTQPSLSHSVSSSSLDFGVVPDASNITDVASTGFDKQQQMKIIGMDREARVLRYREKRKNRKFEKTIRYASRKAYAETRPRI

SEQ ID NO: 411 - protein, 340 aa, Malus x domestica
MALKLCDSCKSATGTLFCRADSAFLCVNCDSKIHAANKLASRHARVWLCEVCEQAPAHVTCKADDAALCVTCDRDIHSANPLSRRHERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 412 - protein, 339 aa, Brassica nigra
MLKQKSNNIDGEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMETHHQTETTEAEPEKRLVIHQEEDEARETASWLLPKDKNSNQNNELLLSDEYLDLADYNSNMDNKFTGQYSHHQQEGDVPQTNYVGDRVVPIQIQESNGSLRHKQQNMTYGSSDINSGSINHNNGYDTSMETDFVPEPTTPDTADGYTTDGKIDQPPEPPVKMIIQLTPMDREARVLRYREKRKTRKFEKTIRYASRKAYAERRPRINGRFAKMGETEDYDVD

SEQ ID NO: 413 - protein, 338 aa, Brassica nigra
MLKQKSNNIDSEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMDTHHQTETTEAEPEKRLVIHQEEDEARETASWLLPKDKNSNQNNELLLSDEYLDLADYNSNMDNKFTGQYNHHQQEGDVPQTNYVGDRVVPIQIQESNGNLRHKQQNMTYSSDINSGSINHNNGYDTSMETDFVPEPTTLDTADGDTTDGKIDQPPEPPVKMIIQLSPMDREARVLRYREKRKTRKFEKTIRYASRKAYAERRPRINGRFAKIGKTEDYDVD

SEQ ID NO: 414 - protein, 339 aa, Brassica nigra
MLKQKSNNIDGEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMETHHQTETTEAEPEKRLVIHQEEDEARETASWLLPKDKNSNQNNELLLSDEYLDLADYNSNMDNKFTGQYSHHQQEGDVPQTNYVGDRVVPIQIQESNGNLRHKQQNMTYGSSDINSGSINHNNGYDTSMETDFVPEPTTPDTADGYTTDGKIDQPPEPPVKMIIQLTPMDREARVLRYREKRKTRKFEKTIRYASRKAYAERRPRINGRFAKMGETEDYDVD

SEQ ID NO: 415 - protein, 339 aa, Brassica nigra
MLKQKSNNIDSEENNRARACDTCMSTVCTVYCHADSAYLCTSCDAEVHSANRVASRHKRVPVCESCECAPAAFLCEADDASLCTACDSEVHSANAIGRRHHRVPVLPVSGNSYISMDTHHQTETTEAEPEKRLVIHQEEDEARETASWLLPKDKNSNQNNELLLSDEYLDLADYNSNMDNKFTGQYNHHQQEGDVPQTNYVGDRVVPIQIQESDGNLRHKQQNMTYGSSDINSGSINHNNGYDTSMETDFVPEPTTLDTADGDTTDGKIDQPPEPPVKMIIQLSPMDREARVLRYREKRKTKKFEKTIRYASRKAYAERRPRINGRFAKMGETEDYDVD

SEQ ID NO: 416 - protein, 339 aa, Brassica nigra
MLKQKSNNIDSEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMDTHHQTETTEAEPEKRLVIHQEEDEARETASWLLPKDKNSNQNNELLLSDEYLDLADYNSNMDNKFTGQYNHHQQEGDVPQTNYVGDRVVPIQIQESDGNLRHKQQNMTYGSSDINSGSINHNNGYDTSMETDFVPEPTTLDTADGDTTDGKIDQPPEPPVKMIIQLSPMDREARVLRYREKRKTKKFEKTIRYASRKAYAERRPRINGRFAKMGETEDYDVD

SEQ ID NO: 417 - protein, 339 aa, Brassica nigra
MLKQKSNNIDSEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMDTHHQTETTEAEPEKRLVIHQEEDEARETASWLLPKDKNSNQNNELLLSDEYLDLADYNSNMDNKFTGQYNRHQQEGDVPQTNYVGDRVVPIQIQESDGNLRHKQQNMTYGSSDINSGSINHNNGYDTSMETDFVPEPTTLDTADGDTTDGKIDQPPEPPVKMIIQLSPMDREARVLRYREKRKTKKFEKTIRYASRKAYAERRPRINGRFAKMGETEDYDVD

SEQ ID NO: 418 - protein, 343 aa, Prunus persica
MASKLCDSCKSATATLFCRADSAFLCVNCDSKIHAANKLASRHARVWLCEVCEQAPAHVTCKADDAALCVTCDRDIHSANPLSRRHERVPVTPFYDSGNSAANSAPVVKSVVNFLDDRYFSDVDGQDAETEVSREEAEAASWLLPNPKAMENPDLNSGEYFLPEMDPYLDLDYGHVDPKLEDAQEQNSCGTDGVVPVQSKSVQPQLVNDHSFEIDFSAASKPYVYGFHAQCLSQSVSSSSMDVSVVPDGNTTMTDVCDPYTKSMSAAVESTHQAVQISSADREARVLRYREKRKNRKFEKTIRYASRKAYAETRPRIKGRFAKRTEVEIEAERLCRYGVVPSF

SEQ ID NO: 419 - protein, 384 aa, Fragaria x ananassa
MLKEESNGAAAANSWARVCDTCRSAPCTVYCRADSAYLCSGCDATIHAANRVASRHERVSVCEACERAPAAFLCKADAASLCTACDADIHSANPLARRHQRVPILPISGCQIMVGSTPADTTEDGFLSQEGDEEVMDEEDEDEAASWLLLNPVKNSNNHNSNNNNPNNNNNGFLFGVEVDEYLDLVEYNSSDQNQFSGTTATNDQHNYGVPHKISYGGDSVVPVQYGEGKVTQMQMQQKHNFHQLGMEYESSKAAYGYDGSISHTVSVSSMDVGVVPDSTMSEMSVCHPRTPKGTIDLFNGPTIQMPTQLSPMDREARVLRYREKKKTRKFEKTIRYASRKAYAETRPRIKGRFAKRTDIEVEVDQMFSTSLMGETGYGIVPSY

SEQ ID NO: 420 - protein, 294 aa, Arabidopsis thaliana
MASSSRLCDSCKSTAATLFCRADAAFLCGNCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYCGFGVVPSF

SEQ ID NO: 421 - protein, 355 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVTCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 422 - protein, 323 aa, Hordeum vulgare subsp. vulgare
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 423 - protein, 498 aa, Populus trichocarpa
MEKCLNSKQKKDCFLFLPCEFCNSKAAILYCRADSAKLCLPCDQQIHSSNTLSLKHVRSQICDNCRAEPASIHCSNDNLFLCQDCDWDSHNSSFSVSSLHNRNPVEGFMGCPPVVELASLFGFDFKSDFFVDSDPGSCSFEQEAVNFQDFAVSSDDFSVLSSSGKSRQEVYKQLVEMGKRGMVRVNGDGAELGPDTPPSRCAVQWNLESLELENGDEELLHQQTPFTSLLMLPNHVDASENDCVSDLGFMWDCNYTHQGAQAWDFQLGTSLDCTIPGPQEEGYDVKDPGFMVKNYVDFTEDGAFATQKVLDDGHVTSCCSSTCEDNLSKNSCSNQQLSRYKPPTENCNNTPLLGLSPGSMPGEPNAHIQVMEQPSLTWFETLNEVRQKGDAGLFAQNRGNAMLRYDKRIRYESRKARADTRKRVKGRGKPVFLGKASPLMLWPELVVTCNPLDHINGEWSFNKHSLQKSLERSSYSDRNNASLSFASTMTVTMLHLRL

SEQ ID NO: 424 - protein, 369 aa, Populus trichocarpa
MLKQESSGGGGGDNRARVCDTCRAAPCTVYCRADSAYLCAGCDARVHAANRVASRHERVSVCEACERAPAALLCKADAASLCTACDADIHSANPLARRHQRVPILPISGCLHGSPVGPAAGETEDRFTTQEGEETISEEEEDEAASWLLLNPVKNSKNQNNNGFLFGGEVDEYLDLVEYNSCTENQCSDQYNQQHYCVPPKSYGGDRAVPIQYGEGKDHQQQRQYHNFQLGLEYEPSKAACSYNGSISQSVSMSSMDVGVVPESTMSEISISQHRPPKGTMELFSSTAIQMPSQLSPMDREARVLRYREKKKTRKFEKTIRYASRKAYAETRPRIKGRFAKRKDVEVEDDQMFSSTLMAETGYGIVPSF

SEQ ID NO: 425 - protein, 348 aa, Populus trichocarpa
MASKLCDSCKSATATLFCRADSAFLCVSCDSKIHAANKLASRHARVWVCEVCEQAPAHVTCKADAAALCVTCDRDIHSANPLAQRHERVPVTPFFDSSSAAHGGGAAVNFLEYRYLDDVNGGDDVSREEAEAESWLLPNPGGGNTKGVDSLDLNTGQYVFGAEMHPYLDLDRYVDQKVEVEVQEQNSSGTTDGVVPVQSNKLGFQAPALVNDNCCFELDFSAGSKTFAGGYGYNSLSHSVSSSSLDVGVVPDGSTLTDISNPYSRSVSNGMESANQTVQLSAVDREARVLRYREKRKNRKFEKTIRYASRKAYAETRPRIKGRFAKRTDSGVEVDRSSIYGFGVVPSF

SEQ ID NO: 426 - protein, 339 aa, Populus trichocarpa
MGIEVESLKNLTGGWSVAAKRCDSCKTAAAAAFCRADSAFLCLNCDTKIHHSGVNSKIMSRHERVWMCEVCEQAPAAVTCKADAAALCVTCDADIHSANPLARRHERVPVEPFYDSAESIVKTSSAFNFLTGDMFFCEMDPFLDFEYQNSMDGRYKQSHGGGGAGADSVVPVQNKPAPLPVIDHKNCFDIDFCRSKLTSFSSYPSQSLSHSVSSSSLDVGVVPDGNSMSDISYPFGRSMNTYTDPSMPISGSTTNQAAAQLAGIDREARVLRYREKRKNRKFEKTIRYASRKAYAETRPRIKGRFAKRTEMESDMDTLYNSPSSVPFLADTHYGVVPSF

SEQ ID NO: 427 - protein, 362 aa, Populus trichocarpa
MGIEVESLKNLTGGWSVAAKRCDSCKTAAAAAFCRADSAFLCLNCDTKIHHSQVNSKIMSRHERVWMCEVCEQAPAAVTCKADAAALCVTCDADIHSANPLARRHERVPIEPFYNSAESIVKTSTAFNILIPGENGVSGYDQNDDVEGVSWLLQSNHTTHDHNSKLQIENPVVKTGDMFFSEIDPFLELEYQNSIDASYEKIHGGAGADSVVPVQTKPAPLPVINHESCFDIDFCRSKLTSFSYSSQSLSHSVSSSSLDVGVVPDGNSIMPLSGWTANQAATQLAGIDREARVLRYRERRKNRKFEKTIRYASRKAYAETRPRIKGRFAKRTEMESDMDNLYNSPSSVPFMADTQYGVVPSF

SEQ ID NO: 428 - protein, 350 aa, Populus trichocarpa
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGEAVNLLEDRYFDEVDGGRGDVSREEAEAESWLLPNPGGGTTKGVDSMDLNTGQYVFGSEMDPYLDLDPYVDPKVEVQEQNSSGTTDGVVPVQSNKLGFQSPALVNDHCCYELDFSTGSKSFGGGYGYNSLSQSVSSSSLDVGVVPDGSGSTLTDISNPYCSRSVCNGMESANQTVQLSAVDREARVLRYREKRKNRKFEKTIRYASRKAYAETRPRIKGRFAKRTDTEVEVDRSSLYGFGVVPSF

SEQ ID NO: 429 - protein, 322 aa, Mangifera indica
MASKLCDSCKSATATLFCRADSAFLCVSCDTKIHTANKLASRHARVWVCEVCEQAPAHVTCKADAAALCVACDHDIHSANPLARRHERVPVTPFYDSVNSADKHNGVVNFFDDVEGGGDASREEAEAASWLLPNPKVVEDGPEMNTGQYVFSDMDPYLDLDYGPVDPKLEAQEQNSSGTDGVVPVQSQTAPVPLVNDHCFDLDFSGPKSFGYGYNNTQCLSHSVSSSSLDVGVVPDGSATTESTNQTVQLSSADREARVLRYREKRKNKKFEKTIRYASRKAYAEMRPRIKGRFAKRTDMDVEADRSSNSSSIYGFGVVPSY

SEQ ID NO: 430 - protein, 347 aa, Vitis vinifera
MVVEVESWRMASKLCDSCKSAPPTLFCRADSAFLCVACDSKVHAANKLASRHARVWMCEVCEQAPAHVTCKADAAALCVTCDRDIHSANPLARRHERVPVVPFYDSAAAAAKSNAVNLLVDDRYYSDPDGDASREEAEAASWLLPNPNPKLAESSDLNSSHYMFSDIDPYLDLDYPSMDPKLQSQQQQQSSGTDGVVPVQNKSVQAPLVNDNCFDMDFSGSKSFYNGQSLSQSVSSSSLEVGVVPDGNAMVDVTNPFGRSMNTGSESANQTAQISSGIDREARVLRYREKRKNRKFEKTIRYASRKAYAETRPRIKGRFAKRSEIEVDYSSSGALTADSGYGVVPSF

SEQ ID NO: 431 - protein, 394 aa, Vitis vinifera
MSDSPGDNLHHRHEEEGQKMTIQNRLCDFCGDSMALLYCRADSAKLCLSCDREVHSTNQLFTKHTRSRLCDVCDASPASILCSTDNLVLCQNCDWAKHGRSLSSAHDRRPLEGFSGQPSVTELLAFVGFEDLGKKSLFCGDESEVNEFLGCGVYESVGVDEEFSDFLVWDTPAVVNLDDLIVSTACDHNFQAMGVPPLPKNRGAPCGQHKAEIIHQLRQLAKIELSFDFDHGDAKPPIGFQSHIPKQLIQKENECNSCDHEVEFVFPTYEASAFQWCSDGSEAANQVLPSVLLGSCADEKCLVPRKHSDIGGSVSHTNGSDEGKSECPVVTKTLPALPKVSVHELNSQERDSAISRYKEKKKTRRYEKHIRYESRKARAESRIRIKGRFAKMDH

SEQ ID NO: 432 - protein, 349 aa, Vitis vinifera
MTIQNRLCDFCGDSMALLYCRADSAKLCLSCDREVHSTNQLFTKHTRSRLCDVCDASPASILCSTDNLVLCQNCDWAKHGRSLSSAHDRRPLEGFSGQPSVTELLAFVGFEDLGKKSLFYFLVWDTPAVVNLDDLIVSTACDHNFQAMGVPPLPKNRGAPCGQHKAEIIHQLRQLAKIELSFDFDHGDAKPPIGFQSHIPKQLIQKENECNSCDHEVEFVFPTYEASAFQWCSDGSEAANQVLPSVLLGSCADEKCLVPRKHSDIGGSVSHTNGSDEGKSECPVVTKTLPALPKVSVHELNSQERDSAISRYKEKKKTRRYEKHIRYESRKARAESRIRIKGRFAKMDH

SEQ ID NO: 433 - protein, 361 aa, Vitis vinifera
MGFQELNGKTFSAATWALAAKPCDSCKSAAALLFCRADSAFLCVGCDSKIHGANKLASRHERVWMCEVCEQAPASVTCKADAAALCVTCDRDIHSANPLARRHDRVPVVPFYDSAESLVKSTAAAVGFLVPGGAGDEEDSEAASWLLPNPKLPEGPEVKSGEVFFSDIDPFLDFDYPDAKFPHHHHHHCGGNDGVVPVQAKDPSPPVTNHPADNCFELDFSRSKLSAYNYTAQSLSQSISSSDVGVVPDGNCNSMSDTSYPSMKQVSGGGGGGSTGSQATQLSGMDREARVLRYREKRKNRKFEKTIRYASRKAYAETRPRIKGRFAKRTEMESEMVDHIYNSASAAAFMVDAGYGVVPSY

SEQ ID NO: 434 - protein, 339 aa, Zea mays
MDTAAELELGLELEQKPAAGYWSVVGARPCDACAAEPARLHCRADGAFLCPGCDARAHGAGSRHARVWLCEVCEHAPAVVTCRADAAALCAACDADIHSANPLARRHERLPIAPLFGALADAPQPFPSPALAAAAGAEAPAPTPAQGEAVAEDYGSSEAEAASWLLPEPDNSHEDSAADTFFAESDAYLGADLDFARCMDGVKAIGVPVAPPELDIGAGSFCYPEHSMNHILSSSSEVAVVPDAQAAGLPVVVVVSRGEEREARLMRYREKRKNRRFDKTIRYASRKAYAETRPRIKGRFAKRRSAEGEDEALEHEEGACFSPAGSAPAASDGVVPSLC

SEQ ID NO: 435 - protein, 336 aa, Sorghum bicolor
MDTAVELELEQKPAVGYWSVVGARPCDACAAEPARLHCREDGAFLCPGCDARAHGAGSRHARVWLCEVCEHAPAAVTCRADAAALCAACDADIHSANPLARRHERLPVAPFFGALADAPQPFPSPAFAAAAAAGGQAQGEAAAADNDDDDGSNEAEAASWLLAEPDNSHEDSAAATAADTLFAESDAYLGVDLDFARCMDGVKAIGVPVAPPELDIAAGSFFYPEHSMNHSLSSSEVAVVPDAQAAGVPAVVSRGKEREARLMRYREKRKNRRFDKTIRYASRKAYAETRPRIKGRFAKRCSAEADDDALEHDEGACFSPAGSAHAASDGVVPSFC

SEQ ID NO: 436 - protein, 317 aa, Allium cepa
MAVNYWGLTAKHCANCVSSPAVMYCRTDATYLCSTCEARSHSSHVRVWLCEVCEQAPAAVTCKADAATLCVTCDADIHAANPLARRHERVPVVPVGNPTVQVKEDLFGEDGEGDTWKGMMVDLNCFGGFSNELVDPYLDLDGNGDGLVPVQEKHVYGYGYRQEKGTMMPKGTVDIDFGAVGKGDGYGCGHGGYTVGVQSMSHSTTVSSSEAGVVPDNSSSMAVADVSNPYSRPLPNPMDAMDREARVMRYREKRKNRKFEKTIRYASRKAYAETRPRIKGRFAKRVDNDSYADPMHSVINASTAFMNDSGYGVVPSF

SEQ ID NO: 437 - protein, 332 aa, Ricinus communis
MASKLCDSCKSATATLFCRPDSAFLCINCDSKIHAANKLASRHARVLICEVCEQAPAHVTCKADAAALCVTCDRDIHSANPLARRHERVPITPFYDSVSSVNNKPNAVNLLDDRYFSDVDGDAADVSREEAEAASWLLPNPPNTKLVENSDPNTGQYVFSDMDPYLDLDYGPGDPKLEAQEQNSSGTDGVVPVKSSKNVQAPFVNDNCFELDFTGSKPFPYGYNAQCLSNSVSSSSLDVGVVPDGGDISNPYSKSTMESVQQLSAVDREARVLRYREKRKNRKFEKTIRYASRKAYAETRPRIKGRFAKRTDIDVEADRSSSINAFGVVPSF

SEQ ID NO: 438 - protein, 411 aa, Ricinus communis
MSDFGRTPDEQQTMMTQQHHQQERLCDYCNDTTALLYCRADSAKLCISCDREVHSTNQLFSKHTRSLLCDSCDASPASIFCETEHSVFCQNCDWEKHNLSLSSVHNRRPIEGFSGFPSVSELVSILGFEDLGDKKDKKALLFNEGDNGLASSGPDGSGFEDGYSDLLIWETPAVVSIDDLIVSSDSGPNFPALGVPPLPKAIVFRFSLFYFSCKSQNRNAVCGQHKEEILRQLRELAGLEPDPNCHNPETEPTYVFQSAAGENMQTRMTHKCCEPVARPISSPSYEENIFNWLSDNGEAGNQVSVPCTLPRSHLEESPVVPDKQSNIDGSASYANGSHEGEPQYPASTGLISVFPKVVSHDINSQERDSAISRYKEKRKTRRYDKHIRYESRKARAESRTRIRGRFAKMDR

SEQ ID NO: 439 - protein, 388 aa, Ricinus communis
MGIEMESLKSLTGGWTVAARRCDSCKTAAAAVFCRADSAFLCLNCDAKIHAANKLVSRHERVWMCEVCEQAPAAVTCKADAAALCVTCDADIHSANPLARRHERVPVEPFFDSAGSIVKSSPFNFLVPTDHNGAGSAAFNHQQHEDDDVEGVSWLLPNPSSTMINSKLGGIENHEMKSGHGGGGGSGDLFFTEMDPFLDLEFHQNNNHSSAANDSVVPVQITKPAAASSIPVMNNDICYDIDFCRTKLSSFNYPTQSLSQSVSSSSLDVGVVPDGSSTSDISYPFGRNMNTCTDPSGPISGNSTNQAAQMCGINREARVLRYREKRKNRKFEKTIRYASRKAYAETRPRIKGRFAKRTEIDTDMDRLYNSPSSVSYLGDAQYGVVPTF

SEQ ID NO: 440 - protein, 351 aa, Glycine max
MSGAEARPCDYCGNSTALLYCRADSAKLCFSCDREVHSTNQLFSKHTRTLLCDACDDSPATILCSTDTSVLCQNCDWENHNPALSDSLHERRPLEGFTGCPSVSELLSIVGFSDISKKSLLFSPQGSVADGFFGASEIEGLSDMFVWDAPSFVTLDDLISSSPSSHSFQAMKVPPLPKNRKAACGQHKEEILSQLRELAKSEPLDLEPYVQSGNLSLGFERDPEADIFPSHEWHRESSEPMHQVVPPDPSMGTYTEEIPVKHSTSAVGENHTYGDNEGKPSISLKSETLSTTPKAAACELTSQERDSALLRYKQKKKTRRFDKHIRYESRKVRAESRVRVKGRFAKMGHEH

SEQ ID NO: 441 - protein, 382 aa, Phyllostachys edulis
MNYNFGGNVYEQEVAGGEGSCPWARPCDGCNAAPSVVYCRADAAYLCASCDSRVHAANRVATRHERVRVCEACERAPAVLACRADAAVLCVSCDAQVHSANPLARRHQRVPVVPLPAAAIPAASVLAEAAAAATTVLGDKEEEVDSWLLLSKDSDNQNCSSNNNNNSMYFGEVDEYFDLVGYNSYYDNRIDNNQEQYGMQEQQQQQQQEMQKEFAEKEGSECVVPSQVAMVSEQQQQSGYVGAEQAASMTAGVSAYTDSISNSISFSSMEVGIVPDNTVIDMPNSSILTPAGAINLFSGPSLQMPLHLSTMDREARVLRYKEKKKTRKFEKTIRYATRKAYAEARPRIKGRFAKRSDVDIEVDQMFSSAALSDCSYGTVPWF

SEQ ID NO: 442 - protein, 307 aa, Vitis vinifera
MASKLCDSCKSAPPTLFCRADSAFLCVACDSKVHAANKLASRHARVWMCEVCEQAPAHVTCKADAAALCVTCDRDIHSANPLARRHERVPVVPFYDSAAAAAKSNAVNLLLAESSDLNSSHYMFSDIDPYLDLDYPSMDPKLQSQQQQQSSGTDGVVPVQNKSVQAPLVNDNCFDMDFSGSKSFYNGQSLSQSVSSSSLEVGVVPDGNAMVDVTNPFGRSMNTGSESANQTAQISSGIDREARVLRYREKRKNRKFEKTIRYASRKAYAETRPRIKGRFAKRSEIEVDYSSSGALTADSGYGVVPSF

SEQ ID NO: 443 - protein, 343 aa, Arabidopsis lyrata subsp. lyrata
MGFGLESIKSISGGWGAAARSCDACKSVTAAVFCRLDSAFLCISCDTRIHSFTRHERVWVCDVCEQAPAAVTCKADAAALCVTCDSDIHSANPLASRHERVPVESFFDSAETAVAKISPSSTFGILGSSTTVDLTAVPVMGDDLGLCPCSSEFMFADFDRLIDFEFPNSFNHPSNNDAGGDSLVPVQTKTEPLPLTNNDHCFDIDFCRSKLSAFTYPSQSVSHSVSTSSIEYGVVPDGNTNNSVSEISIPFNRSMITTSTAASTGDHQTSSMDREARVLRYREKRKNRKFEKTIRYASRKAYAESRPRIKGRFAKRTETENDDVFLSHVYASAATQYGVVPTF

SEQ ID NO: 444 - protein, 291 aa, Arabidopsis lyrata subsp. lyrata
MASSRLCDSCKSTTATLFCRADAAFLCGVCDGKIHTANKLASRHERVWLCEVCEQAPAHVTCKADAAALCVTCDRDIHSANPLSSRHERVPITPFYDTSPAKSASSSINFVDEDGGDVSASWLLHKEGIEITNLFSDLDYPKMEVTSENNSSGNDGVVPVQSKMFLNEDYFNFDLSASKISSNGFNFINQTVSRSIDVALVPESGGVTAEITNTATVTPAVQLSPAEREARVLRYREKRKNRKFEKTIRYASRKAYAEMRPRIKGRFAKRTDSRENDGGDVGVYGGFGVVP

SEQ ID NO: 445 - protein, 342 aa, Brassica rapa
MGFGLESIKPLSGGWGAAARSCDACKSASAAVYCRFDSAFLCVTCDTSIHSFTRHERVYLCEVCEQAPAAVTCKADAASLCVTCDSDIHSANPLASRHERVPVESFFDSAVAKISPSTFGVLGDSTTVDLTAVPVIGNADELGLCPWLLPNDFNEPAKIETVTELKSSEFMFSDFDRLIDFEYPNTFGADSLVPVQTKTEPLPVTNNDHCFDIDFCRSKLSTFTYPTQSISHSVSTSSLEYGVVPDGTTSVPFNRSTITTSTGTTGEQPSSMDREARVLRYREKRKNRKFEKTIRYASRKAYAESRPRIKGRFAKRTETENDDVFFSQVYASAGQYGVVPTF

SEQ ID NO: 446 - protein, 307 aa, Raphanus sativus
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTNATPAVQLSPAEREARVLRYREKRKNRKFEKTIRYASRKAYAEVRPRIKGRFAKRTDSRVNDGGGDVGVYGGFGVVPSF

SEQ ID NO: 447 - protein, 340 aa, Malus x domestica
MALKLCDSCKSATGTLFCRADSAFLCVNCDSKIHAANKLASRHARVWLCEVCEQAPAHVTCKADDAALCVTCDRDIHSANPLSHADERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 448 - protein, 329 aa, Malus x domestica
MASKLCDSCQSATATLFCRADSAFLCVNCDSKIHAANKLASRHPRVWLCEVCEQAPAHVTCKADDAALCVTCDRDIHSANPLSSRHDRVPVTPFYDSVNSAANSVPVVKSVVNFLDDRYLSDVDGETEVSREEAEAASWLLPNPKAMENPDLNSGQYLFQEMDPYLDLDYGHVDPKLEEAQEQNSCGADGVVPVQSKNMQPLLVNDQSFELDFSAGSKPFVYGYHHARCLSQSVSSSSMDISVVPDGNAVTAAVETSQPAVQLSSVDRVARVLRYREKRKNRKFEKTIRYASRKAYAETRPRIKGRFAKRTEVEIEAERMCRYGVVPSF

SEQ ID NO: 449 - protein, 409 aa, Solanum lycopersicum
MLKKENSGGLDGSSNYWARVCDSCRSVTCTIYCQADSAYLCADCDARIHAASLVTSRHKRVWVCEACERAPAAFLCKADAASLCASCDADIHSANPLAHRHHRIPIITIPGTLYGPPAVETVGGDSMMISGSTGEGTEDDGFLSLTQDADDTIIDEEDEDEDEAASWLLLNHPVKNNNKNNVNNNNNQTNNYDMLFGGEVVDDYLDLAEYGGDSQFNDQYNVNQQQQQYFVPQMSYGGDSVVPVQDGQGKPLIFYQQQQQQQQSHHQNFQLGMEYDNSNTRLGLPASMSHSVSVVSMDVSVVPESALCETSNSQPRPQKGTIELFSGHPIQIPLLTPMDREARVLRYREKKKNRKFEKTIRYASRKAYAETRPRIKGRFAKRTDVEAEVDQMFSTQLMTDSSYRIVPSF

SEQ ID NO: 450 - protein, 312 aa, Pisum sativum
MATKLCDSCKSTKATLFCRSDSAFLCITCDSNIQAANKLASRHHRVTLCEVCEQAPAHVTCKADAAALCVSCDHDIHSANPPASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSSSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 451 - protein, 312 aa, Pisum sativum
MATKLCDSCKSTKATLFCRSDSAFLCITCDSNIHAANKLASRHHRVTLCEVCEQAPAHVTCKADAAALCVSCDHDIHSANPLASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSPSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 452 - protein, 351 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

The invention claimed is:

1. A transgenic corn plant or a plant part thereof comprising (i) a first recombinant expression cassette comprising a first heterologous plant-expressible promoter operably linked to a transcribable DNA sequence encoding a non-coding RNA for suppression of one or more gibberellic acid 20 (GA20) oxidase genes, and ii) a second recombinant expression cassette comprising a DNA sequence encoding a polypeptide having at least 95% amino acid sequence identity to the amino acid sequence as set forth in SEQ ID NO: 168; wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15; and wherein expression of said non-coding RNA and said polypeptide in said transgenic corn plant results in a semi-dwarf phenotype, and an increase in one or more improved ear trait selected from the group consisting of ear diameter, single kernel weight, ear fresh weight, ear area, ear volume, ear length, kernels per ear and grain yield estimate as compared to a control wild-type corn plant grown under comparable conditions.

2. The transgenic corn plant or plant part thereof of claim 1, wherein the transcribable DNA sequence encoding said non-coding RNA comprises a nucleotide sequence that is 100% identical or complementary to at least 15 consecutive nucleotides of SEQ ID NO: 39.

3. The transgenic corn plant or plant part thereof of claim 1, wherein the polypeptide comprises the amino acid sequence as set forth in SEQ ID NOs: 168.

4. The transgenic corn plant or plant part thereof of claim 1, wherein the DNA sequence encoding said polypeptide comprises a nucleotide sequence that is at least 90% identical to the nucleotide sequence as set forth in SEQ ID NO: 169.

5. The transgenic corn plant or plant part thereof of claim 1, wherein the DNA sequence comprised in the second recombinant expression cassette is operably linked to a second heterologous plant-expressible promoter.

6. The transgenic corn plant or plant part thereof of claim 1, wherein the first heterologous plant-expressible promoter is selected from the group consisting of a vascular promoter, a leaf promoter and a constitutive promoter.

7. The transgenic corn plant or plant part thereof of claim 6, wherein the first heterologous plant-expressible promoter is said vascular promoter selected from the group consisting of a sucrose synthase promoter, a sucrose transporter promoter, a sucrose synthase-1 (Sh 1) promoter, a Commelina yellow mottle virus (CoYMV) promoter, a wheat dwarf geminivirus (WDV) large intergenic region (LIR) promoter, a maize streak geminivirus (MSV) coat polypeptide (CP) promoter, a rice yellow stripe 1 (YS1)-like promoter, and a rice yellow stripe 2 (OsYSL2) promoter.

8. The transgenic corn plant or plant part thereof of claim 6, wherein the first heterologous plant-expressible promoter is said leaf promoter selected from the group consisting of a RuBisCO promoter, a pyruvate phosphate dikinase (PPDK) promoter, a fructose 1-6 bisphosphate aldolase (FDA) promoter, a Nadh-Gogat promoter, a chlorophyll a/b binding polypeptide gene promoter, a phosphoenolpyruvate carboxylase (PEPC) promoter and a Myb gene promoter.

9. The transgenic corn plant or plant part thereof of claim 6, wherein the first heterologous plant-expressible promoter is said constitutive promoter selected from the group consisting of an actin promoter, a Cauliflower mosaic virus (CaMV) 35S promoter, a CaMV 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, and a maize alcohol dehydrogenase promoter.

10. The transgenic corn plant or plant part thereof of claim 1, wherein the first heterologous plant-expressible promoter is a rice tungro bacilliform virus (RTBV) promoter.

11. The transgenic corn plant or plant part thereof of claim 10, wherein the RTBV promoter comprises a DNA sequence that is at least 95% identical to the nucleotide sequence as set forth in SEQ ID NO: 65 or SEQ ID NO: 66.

12. The transgenic corn plant or plant part thereof of claim 5, wherein the second heterologous plant-expressible promoter is selected from the group consisting of a vascular promoter, and a constitutive promoter.

13. The transgenic corn plant or plant part thereof of claim 12, wherein the second heterologous plant-expressible promoter is said constitutive promoter comprising a DNA sequence that is at least 95% identical to the nucleotide sequence as set forth in SEQ ID NO: 172.

14. The transgenic corn plant or plant part thereof of claim 12, wherein the second heterologous plant-expressible promoter is said constitutive promoter selected from the group consisting of an actin promoter, a Cauliflower mosaic virus (CaMV) 35S promoter, a CaMV 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, and a maize alcohol dehydrogenase promoter.

15. A transgenic corn seed or a part thereof of the transgenic corn plant of claim 1, wherein the transgenic corn seed and said part thereof comprises the first and second recombinant expression cassettes.

16. A commodity product produced from the transgenic corn plant or a part thereof of claim 1, wherein the commodity product comprises the first and second recombinant expression cassettes.

17. A recombinant DNA construct comprising (i) a first expression cassette comprising a first heterologous plant-expressible promoter operably linked to a transcribable DNA sequence encoding a non-coding RNA for suppression of one or more GA20 oxidase genes, and (ii) a second expression cassette comprising a second heterologous plant-expressible promoter operably to a DNA sequence encoding a polypeptide having at least 95% amino acid sequence identity to the amino acid sequence as set forth in SEQ ID NO: 168; wherein the non-coding RNA comprises a targeting sequence that is (a) at least 95% complementary to at least 19 consecutive nucleotides of a first mRNA molecule encoding a first endogenous GA20 oxidase protein that has at least 95% amino acid sequence identity to the amino acid sequence as set forth in SEQ ID NO: 9, and (b) at least 95% complementary to at least 19 consecutive nucleotides of a second mRNA molecule encoding a second endogenous GA20 oxidase protein that has at least 95% amino acid sequence identity to the amino acid sequence as set forth in SEQ ID NO: 15; and wherein expression of said non-coding RNA and said polypeptide in a corn plant results in a semi-dwarf phenotype, and an increase in one or more improved ear trait selected from the group consisting of ear diameter, single kernel weight, ear fresh weight, ear area, ear volume, ear length, kernels per ear, yield, grain yield estimate, broad acreage yield, ear dry weight, and ear tip void, as compared to a control wild-type corn plant grown under comparable conditions.

18. The recombinant DNA construct of claim 17, wherein the transcribable DNA sequence encoding said non-coding RNA comprises a nucleotide sequence that is 100% identical or complementary to at least 15 consecutive nucleotides of one or more of SEQ ID NO: 39.

19. The recombinant DNA construct of claim 17, wherein the polypeptide comprises the amino acid sequence as set forth in SEQ ID NOs: 168.

20. The recombinant DNA construct of claim 17, wherein the DNA sequence encoding said polypeptide comprises a nucleotide sequence that is at least 90% identical to the nucleotide sequence as set forth in SEQ ID NO: 169.

21. The recombinant DNA construct of claim 17, wherein the first heterologous plant-expressible promoter is selected from the group consisting of a vascular promoter, a leaf promoter, and a constitutive promoter.

22. The recombinant DNA construct of claim 21, wherein the first heterologous plant-expressible promoter is said vascular promoter selected from the group consisting of a sucrose synthase promoter, a sucrose transporter promoter, a sucrose synthase-1 (Sh 1) promoter, a Commelina yellow mottle virus (CoYMV) promoter, a wheat dwarf geminivirus (WDV) large intergenic region (LIR) promoter, a maize streak geminivirus (MSV) coat polypeptide (CP) promoter, a rice yellow stripe 1 (YS1)-like promoter, and a rice yellow stripe 2 (OsYSL2) promoter.

23. The recombinant DNA construct of claim 21, wherein the first heterologous plant-expressible promoter is said leaf promoter selected from the group consisting of a RuBisCO promoter, a pyruvate phosphate dikinase (PPDK) promoter, a fructose 1-6 bisphosphate aldolase (FDA) promoter, a Nadh-Gogat promoter, a chlorophyll a/b binding polypeptide gene promoter, a phosphoenolpyruvate carboxylase (PEPC) promoter, and a Myb gene promoter.

24. The recombinant DNA construct of claim 21, wherein the first heterologous plant-expressible promoter is said constitutive promoter selected from the group consisting of an actin promoter, a Cauliflower mosaic virus (CaMV) 35S promoter, a CaMV 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu 9 promoter, a tubulin promoter, a nopaline synthase promoter, an octopine synthase promoter, a mannopine synthase promoter, and a maize alcohol dehydrogenase promoter.

25. The recombinant DNA construct of claim 17, wherein the first heterologous plant-expressible promoter is a rice tungro bacilliform virus (RTBV) promoter.

26. The recombinant DNA construct of claim 25, wherein the RTBV promoter comprises a DNA sequence that is at least 95% identical to the nucleotide sequence as set forth in SEQ ID NO: 65 or SEQ ID NO: 66.

27. The recombinant DNA construct of claim 17, wherein the second heterologous plant-expressible promoter is selected from the group consisting of a vascular promoter, and a constitutive promoter.

28. The recombinant DNA construct of claim 27, wherein the second heterologous plant-expressible promoter is said constitutive promoter comprising a DNA sequence that is at least 95% identical to the nucleotide sequence as set forth in SEQ ID NO: 172.

29. The recombinant DNA construct of claim 27, wherein the second heterologous plant-expressible promoter is said constitutive promoter selected from the group consisting of an actin promoter, a Cauliflower mosaic virus (CaMV) 35S promoter, a CaMV 19S promoter, a plant ubiquitin promoter, a plant Gos2 promoter, a Figwort mosaic virus (FMV) promoter, a cytomegalovirus (CMV) promoter, a mirabilis mosaic virus (MMV) promoter, a peanut chlorotic streak caulimovirus (PCLSV) promoter, an Emu promoter, a tubulin promoter, a nopaline synthase promoter, an octopine synthase promoter, a mannopine synthase promoter, and a maize alcohol dehydrogenase promoter.

30. The transgenic corn plant or plant part thereof of claim 1, wherein the first heterologous plant-expressible promoter is a vascular promoter.

31. The transgenic corn plant or plant part thereof of claim 1, wherein the first heterologous plant-expressible promoter is a leaf promoter.

32. The transgenic corn plant or plant part thereof of claim 1, wherein the first heterologous plant-expressible promoter is a constitutive promoter.

33. The transgenic corn plant or plant part thereof of claim 5, wherein the second heterologous plant-expressible promoter is a vascular promoter.

34. The transgenic corn plant or plant part thereof of claim 5, wherein the second heterologous plant-expressible promoter is a constitutive promoter.

* * * * *